(12) United States Patent
Moore et al.

(10) Patent No.: US 12,006,345 B2
(45) Date of Patent: Jun. 11, 2024

(54) UNTARGETED AND TARGETED IL-10 Fc-FUSION PROTEINS

(71) Applicant: Xencor, Inc, Pasadena, CA (US)

(72) Inventors: Gregory Moore, Azusa, CA (US); Rajat Varma, Hamden, CT (US); Yoon Kyung Kim, Pomona, CA (US); Rumana Rashid, Temple City, CA (US); Alex Nisthal, Monrovia, CA (US); Juan Diaz, Anaheim Hills, CA (US); Matthew Bernett, Monrovia, CA (US); Michael Hedvat, Encino, CA (US)

(73) Assignee: Xencor, Inc., Pasadena, CA (US)

( * ) Notice: Subject to any disclaimer, the term of this patent is extended or adjusted under 35 U.S.C. 154(b) by 18 days.

(21) Appl. No.: 16/798,247

(22) Filed: Feb. 21, 2020

(65) Prior Publication Data

US 2021/0171596 A1   Jun. 10, 2021

Related U.S. Application Data

(60) Provisional application No. 62/808,749, filed on Feb. 21, 2019, provisional application No. 62/808,751, filed on Feb. 21, 2019.

(51) Int. Cl.
   *C07K 14/54* (2006.01)
(52) U.S. Cl.
   CPC ...... *C07K 14/5428* (2013.01); *C07K 2319/30* (2013.01)
(58) Field of Classification Search
   None
   See application file for complete search history.

(56) References Cited

U.S. PATENT DOCUMENTS

| | | | |
|---|---|---|---|
| 9,346,872 B2 | 5/2016 | Duerner et al. | |
| 9,447,159 B2 | 9/2016 | Ast et al. | |
| 9,493,564 B2 * | 11/2016 | Thompson | A61P 1/00 |
| 2003/0186386 A1 | 10/2003 | Hansen et al. | |
| 2012/0100139 A1 | 4/2012 | Thompson et al. | |
| 2012/0276125 A1 | 11/2012 | Ast et al. | |
| 2014/0044674 A1 | 2/2014 | Duerner et al. | |
| 2016/0175458 A1 | 6/2016 | Alvarez et al. | |
| 2016/0263240 A1 | 9/2016 | Ast et al. | |
| 2016/0340413 A1 | 11/2016 | Duerner et al. | |
| 2017/0368144 A1 * | 12/2017 | Moustakas | C07K 14/5428 |

FOREIGN PATENT DOCUMENTS

| | | | |
|---|---|---|---|
| WO | WO2001007081 A1 | 2/2001 | |
| WO | WO2001058950 A1 | 8/2001 | |
| WO | WO2001058957 A2 | 8/2001 | |
| WO | WO2002002143 A2 | 1/2002 | |
| WO | WO2002072605 A2 | 9/2002 | |
| WO | WO-2004044006 A1 * | 5/2004 | A61K 47/60 |
| WO | WO2004044006 A1 | 5/2004 | |
| WO | WO2004056850 A2 | 7/2004 | |
| WO | WO2006130580 A2 | 12/2006 | |
| WO | WO2007061657 A2 | 5/2007 | |
| WO | WO2007128563 A1 | 11/2007 | |
| WO | WO2009056268 A1 | 5/2009 | |
| WO | WO2010040105 A2 | 4/2010 | |
| WO | WO2010133828 A1 | 11/2010 | |
| WO | WO2012045334 A1 | 4/2012 | |
| WO | WO2012178137 A1 | 12/2012 | |
| WO | WO2013070076 A1 | 5/2013 | |
| WO | WO2014023673 A1 | 2/2014 | |
| WO | WO2014055897 A2 | 4/2014 | |
| WO | WO2014145806 A2 | 9/2014 | |
| WO | WO2014176373 A2 | 10/2014 | |
| WO | WO2015044386 A1 | 4/2015 | |
| WO | WO2015065987 A1 | 5/2015 | |
| WO | WO2015070060 A1 | 5/2015 | |
| WO | WO2015108785 A1 | 7/2015 | |
| WO | WO2015117930 A1 | 8/2015 | |
| WO | WO2016082677 A1 | 6/2016 | |
| WO | WO2016100788 A1 | 6/2016 | |
| WO | WO2016172427 A1 | 10/2016 | |
| WO | WO2016180969 A1 | 11/2016 | |
| WO | WO2017087768 A1 | 11/2016 | |
| WO | WO2016196211 A1 | 12/2016 | |
| WO | WO2017023749 A1 | 2/2017 | |
| WO | WO2017210684 A1 | 12/2017 | |
| WO | WO2017220988 A1 | 12/2017 | |
| WO | WO2018005226 A2 | 1/2018 | |
| WO | WO2018034620 A1 | 2/2018 | |
| WO | WO2018053080 A1 | 3/2018 | |
| WO | WO2018064611 A1 | 4/2018 | |
| WO | WO2018071919 A1 | 4/2018 | |
| WO | WO2018080277 A1 | 5/2018 | |

(Continued)

OTHER PUBLICATIONS

Skolnick et al (Trends Biotechnol. Jan. 2000;18(1):34-9) (Year: 2000).*
Burgess et al. (J. Cell Biol. 111:2129-2138, 1990) (Year: 1990).*
Miosge (Proc Natl Acad Sci U S A. Sep. 15, 2015;112(37):E5189-98) (Year: 2015).*
Bork (Genome Research, 2000, 10:398-400) (Year: 2000).*
Guo et al., Purification and characterization of human IL-10/Fc fusion protein expressed in Pichia pastoris., Protein Expression and Purification, vol. 83, Issue 2, Jun. 2012, pp. 152-156.

(Continued)

*Primary Examiner* — Brian Gangle
*Assistant Examiner* — Andrea K McCollum
(74) *Attorney, Agent, or Firm* — Jennifer Patritti Cram; Christopher J. Betti; Morgan, Lewis & Bockius, LLP

(57) ABSTRACT

The present invention provides untargeted and targeted IL-10-Fc fusion proteins, compositions and methods of use thereof. The targeted IL-10-Fc fusion proteins includes those that bind PD-1, TIGIT, CD8 and NKG2D.

13 Claims, 246 Drawing Sheets

Specification includes a Sequence Listing.

(56) References Cited

FOREIGN PATENT DOCUMENTS

| | | |
|---|---|---|
| WO | WO2018117613 A1 | 6/2018 |
| WO | WO2018140831 A2 | 8/2018 |
| WO | WO2018144955 A1 | 8/2018 |
| WO | WO2018160993 A1 | 9/2018 |
| WO | WO2018161017 A1 | 9/2018 |
| WO | WO2018161026 A1 | 9/2018 |
| WO | WO2018175993 A1 | 9/2018 |
| WO | WO2018183931 A1 | 10/2018 |
| WO | WO2018203072 A1 | 11/2018 |
| WO | WO2018234793 A2 | 12/2018 |
| WO | WO2019010224 A1 | 1/2019 |
| WO | WO2019024979 A1 | 2/2019 |
| WO | WO2019025391 A1 | 2/2019 |
| WO | WO2019057180 A1 | 3/2019 |
| WO | WO2019057181 A1 | 3/2019 |
| WO | WO2019094268 A1 | 5/2019 |
| WO | WO2019129644 A1 | 7/2019 |
| WO | WO2019173829 A1 | 9/2019 |
| WO | WO2019191519 A1 | 10/2019 |
| WO | WO2019197583 A1 | 10/2019 |
| WO | WO2019215510 A2 | 11/2019 |
| WO | WO2019234136 A1 | 12/2019 |
| WO | WO2020006385 A2 | 1/2020 |

OTHER PUBLICATIONS

Moore et al., A robust heterodimeric Fc platform engineered for efficient development of bispecific antibodies of multiple formats., Methods Feb. 1, 2019;154:38-50.

Qiao et al., Targeting Tumors with IL-10 Prevents Dendritic Cell-Mediated CD8+ T Cell Apoptosis., Cancer Cell 35, 901-915, Jun. 10, 2019.

Westerhof et al. (2012) 3D Domain Swapping Causes Extensive Multimerisation of Human Interleukin-10 When Expressed in Planta. PLoS ONE 7(10): e46460. doi:10.1371/journal.pone.0046460.

Yoon et al., Epstein-Barr Virus IL-10 Engages IL-10R1 by a Two-step Mechanism Leading to Altered Signaling Properties., The Journal of Biological Chemistry vol. 287, No. 32, pp. 26586-26595, Aug. 3, 2012.

Tan, Philip, Presentation at PepTalk, Jan. 25, 2013, "Bi-specific ADAPTIR Molecule Targeting CD86 and Delivering Monomeric IL10 to Inhibit Antigen Presenting Cells".

Asiedu et al., Cloning and characterization of recombinant rhesus macaque IL-10/Fcala-ala fusion protein: A potential adjunct for tolerance induction strategies., Cytokine 40 (2007) 183-192.

Zhang et al., Bispecific SCORPION™ Molecules Containing Anti-CD86 scFv and IL10 Monomers Selectively Inhibit Antigen Presenting Cells., IBC's 21st Annual International Conference, Antibody Engineering and Antibody Therapeutics Dec. 5-9, 2010 2010, San Diego, CA, USA.

Josephson et al., Design and Analysis of an Engineered Human Interleukin-10 Monomer., The Journal of Biological Chemistry., vol. 275, No. 18, Issue of May 5, pp. 13552-13557, 2000.

Pellerin et al., APVO210: A Bispecific Anti-CD86-IL-10 Fusion Protein (ADAPTIR™) to Induce Antigen-Specific T Regulatory Type 1 Cells., Front Immunol. May 25, 2018;9:881. doi: 10.3389/fimmu.2018.00881. eCollection 2018.

* cited by examiner

Figure 1

Human IL-10 (109H) precursor sequence (SEQ ID NO:1)
>sp|P22301
MHSSALLCCLVLLTGVRASPGQGTQSENSCTHFPGNLPNMLRDLRDAFSRVKTFFQMKDQLDNLLLKESLLEDFKGY
LGCQALSEMIQFYLEEVMPQAENQDPDIKAHVNSLGENLKTLRLRLRRCHRFLPCENKSKAVEQVKNAFNKLQEKGI
YKAMSEFDIFINYIEAYMTMKIRN

Human IL-10 (109L) precursor sequence (SEQ ID NO:2)
>tr|Q6FGS9
MHSSALLCCLVLLTGVRASPGQGTQSENSCTHFPGNLPNMLRDLRDAFSRVKTFFQMKDQLDNLLLKESLLEDFKGY
LGCQALSEMIQFYLEEVMPQAENQDPDIKAHVNSLGENLKTLRLRLRRCLRFLPCENKSKAVEQVKNAFNKLQEKGI
YKAMSEFDIFINYIEAYMTMKIRN

Human IL-10 (109H) mature form sequence (SEQ ID NO:3)
>sp|P22301|19-178
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRN

Human IL-10 (109L) mature form sequence (SEQ ID NO:4)
>tr|Q6FGS9|19-178
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

Human IL-10 receptor subunit alpha (IL10R1 or IL10RA) sequence (SEQ ID NO:5)
>sp|Q13651
MLPCLVVLLAALLSLRLGSDAHGTELPSPPSVWFEAEFFHHILHWTPIPNQSESTCYEVALLRYGIESWNSISNCSQ
TLSYDLTAVTLDLYHSNGYRARVRAVDGSRHSNWTVTNTRFSVDEVTLTVGSVNLEIHNGFILGKIQLPRPKMAPAN
DTYESIFSHFREYEIAIRKVPGNFTFTHKKVKHENFSLLTSGEVGEFCVQVKPSVASRSNKGMWSKEECISLTRQYF
TVTNVIIFFAFVLLLSGALAYCLALQLYVRRRKKLPSVLLFKKPSPFIFISQRPSPETQDTIHPLDEEAFLKVSPEL
KNLDLHGSTDSGFGSTKPSLQTEEPQFLLPDPHPQADRTLGNREPPVLGDSCSSGSSNSTDSGICLQEPSLSPSTGP
TWEQQVGSNSRGQDDSGIDLVQNSEGRAGDTQGGSALGHHSPPEPEVPGEEDPAAVAFQGYLRQTRCAEEKATKTGC
LEEESPLTDGLGPKFGRCLVDEAGLHPPALAKGYLKQDPLEMTLASSGAPTGQWNQPTEEWSLLALSSCSDLGISDW
SFAHDLAPLGCVAAPGGLLGSFNSDLVTLPLISSLQSSE

Human IL-10 receptor subunit alpha (IL10R1 or IL10RA), extracellular domain (SEQ ID NO:6)
>sp|Q13651|22-235
HGTELPSPPSVWFEAEFFHHILHWTPIPNQSESTCYEVALLRYGIESWNSISNCSQTLSYDLTAVTLDLYHSNGYRA
RVRAVDGSRHSNWTVTNTRFSVDEVTLTVGSVNLEIHNGFILGKIQLPRPKMAPANDTYESIFSHFREYEIAIRKVP
GNFTFTHKKVKHENFSLLTSGEVGEFCVQVKPSVASRSNKGMWSKEECISLTRQYFTVTN

Human IL-10 receptor subunit beta (IL10R1 or IL10RB) sequence (SEQ ID NO:7)
>sp|Q08334
MAWSLGSWLGGCLLVSALGMVPPPENVRMNSVNFKNILQWESPAFAKGNLTFTAQYLSYRIFQDKCMNTTLTECDFS
SLSKYGDHTLRVRAEFADEHSDWVNITFCPVDDTIIGPPGMQVEVLADSLHMRFLAPKIENEYETWTMKNVYNSWTY
NVQYWKNGTDEKFQITPQYDFEVLRNLEPWTTYCVQVRGFLPDRNKAGEWSEPVCEQTTHDETVPSWMVAVILMASV
FMVCLALLGCFALLWCVYKKTKYAFSPRNSLPQHLKEFLGHPHHNTLLFFSFPLSDENDVFDKLSVIAEDSESGKQN
PGDSCSLGTPPGQGPQS

Human IL-10 receptor subunit beta (IL10R1 or IL10RB), extracellular domain (SEQ ID NO:8)
>sp|Q08334|20-220
MVPPPENVRMNSVNFKNILQWESPAFAKGNLTFTAQYLSYRIFQDKCMNTTLTECDFSSLSKYGDHTLRVRAEFADE
HSDWVNITFCPVDDTIIGPPGMQVEVLADSLHMRFLAPKIENEYETWTMKNVYNSWTYNVQYWKNGTDEKFQITPQY
DFEVLRNLEPWTTYCVQVRGFLPDRNKAGEWSEPVCEQTTHDETVPS

Figure 2

Mouse IL-10 precursor sequence (SEQ ID NO:9)
>sp|P18893
MPGSALLCCLLLLTGMRISRGQYSREDNNCTHFPVGQSHMLLELRTAFSQVKTFFQTKDQLDNILLTDSLMQDFKGY
LGCQALSEMIQFYLVEVMPQAEKHGPEIKEHLNSLGEKLKTLRMRLRRCHRFLPCENKSKAVEQVKSDFNKLQDQGV
YKAMNEFDIFINCIEAYMMIKMKS

Mouse IL-10 mature form sequence (SEQ ID NO:10)
>sp|P18893|19-178
SRGQYSREDNNCTHFPVGQSHMLLELRTAFSQVKTFFQTKDQLDNILLTDSLMQDFKGYLGCQALSEMIQFYLVEVM
PQAEKHGPEIKEHLNSLGEKLKTLRMRLRRCHRFLPCENKSKAVEQVKSDFNKLQDQGVYKAMNEFDIFINCIEAYM
MIKMKS

Mouse IL-10 receptor subunit alpha (IL10R1 or IL10RA) sequence (SEQ ID NO:11)
>sp|Q61727
MLSRLLPFLVTISSLSLEFIAYGTELPSPSYVWFEARFFQHILHWKPIPNQSESTYYEVALKQYGNSTWNDIHICRK
AQALSCDLTTFTLDLYHRSYGYRARVRAVDNSQYSNWTTTETRFTVDEVILTVDSVTLKAMDGIIYGTIHPPRPTIT
PAGDEYEQVFKDLRVYKISIRKFSELKNATKRVKQETFTLTVPIGVRKFCVKVLPRLESRINKAEWSEEQCLLITTE
QYFTVTNLSILVISMLLFCGILVCLVLQWYIRHPGKLPTVLVFKKPHDFFPANPLCPETPDAIHIVDLEVFPKVSLE
LRDSVLHGSTDSGFGSGKPSLQTEESQFLLPGSHPQIQGTLGKEESPGLQATCGDNTDSGICLQEPGLHSSMGPAWK
QQLGYTHQDQDDSDVNLVQNSPGQPKYTQDASALGHVCLLEPKAPEEKDQVMVTFQGYQKQTRWKAEAAGPAECLDE
EIPLTDAFDPELGVHLQDDLAWPPPALAAGYLKQESQGMASAPPGTPSRQWNQLTEEWSLLGVVSCEDLSIESWRFA
HKLDPLDCGAAPGGLLDSLGSNLVTLPLISSLQVEE

Mouse IL-10 receptor subunit alpha (IL10R1 or IL10RA), extracellular domain (SEQ ID NO:12)
>sp|Q61727|17-241
LEFIAYGTELPSPSYVWFEARFFQHILHWKPIPNQSESTYYEVALKQYGNSTWNDIHICRKAQALSCDLTTFTLDLY
HRSYGYRARVRAVDNSQYSNWTTTETRFTVDEVILTVDSVTLKAMDGIIYGTIHPPRPTITPAGDEYEQVFKDLRVY
KISIRKFSELKNATKRVKQETFTLTVPIGVRKFCVKVLPRLESRINKAEWSEEQCLLITTEQYFTVTNLSI

Mouse IL-10 receptor subunit beta (IL10R1 or IL10RB) sequence (SEQ ID NO:13)
>sp|Q61190
MAPCVAGWLGGFLLVPALGMIPPPEKVRMNSVNFKNILQWEVPAFPKTNLTFTAQYESYRSFQDHCKRTASTQCDFS
HLSKYGDYTVRVRAELADEHSEWVNVTFCPVEDTIIGPPEMQIESLAESLHLRFSAPQIENEPETWTLKNIYDSWAY
RVQYWKNGTNEKFQVVSPYDSEVLRNLEPWTTYCIQVQGFLLDQNRTGEWSEPICERTGNDEITPSWIVAIILIVSV
LVVFLFLLGCFVVLWLIYKKTKHTFRSGTSLPQHLKEFLGHPHHSTFLLFSFPPPEEAEVFDKLSIISEESEGSKQS
PEDNCASEPPSDPGPRELESKDEAPSPPHDDPKLLTSTSEV

Mouse IL-10 receptor subunit beta (IL10R1 or IL10RB), extracellular domain (SEQ ID NO:14)
>sp|Q61190|20-220
MIPPPEKVRMNSVNFKNILQWEVPAFPKTNLTFTAQYESYRSFQDHCKRTASTQCDFSHLSKYGDYTVRVRAELADE
HSEWVNVTFCPVEDTIIGPPEMQIESLAESLHLRFSAPQIENEPETWTLKNIYDSWAYRVQYWKNGTNEKFQVVSPY
DSEVLRNLEPWTTYCIQVQGFLLDQNRTGEWSEPICERTGNDEITPS

Figure 3

Cynomolgus IL-10 precursor sequence (SEQ ID NO:15)
>sp|P79338
MHSSALLCCLVLLTGVRASPGQGTQSENSCTRFPGNLPHMLRDLRDAFSRVKTFFQMKDQLDNILLKESLLEDFKGY
LGCQALSEMIQFYLEEVMPQAENHDPDIKEHVNSLGENLKTLRLRLRRCHRFLPCENKSKAVEQVKNAFSKLQEKGV
YKAMSEFDIFINYIEAYMTMKIRN

Cynomolgus IL-10 mature form sequence (SEQ ID NO:16)
>sp|P79338|19-178
SPGQGTQSENSCTRFPGNLPHMLRDLRDAFSRVKTFFQMKDQLDNILLKESLLEDFKGYLGCQALSEMIQFYLEEVM
PQAENHDPDIKEHVNSLGENLKTLRLRLRRCHRFLPCENKSKAVEQVKNAFSKLQEKGVYKAMSEFDIFINYIEAYM
TMKIRN

Cynomolgus IL-10 receptor subunit alpha (IL10R1 or IL10RA) sequence (SEQ ID NO:17)
>tr|A0A2K5WJ66
MLPRLVVLLAAFLSRRLGSDAHGTELPSPPSVWFEAEFFHHILHWTPIPNQSESTCYEVALLRYGTGRWNSISNCSQ
ALSYDLTAVTLDLYRSNGYRARVRAVDGSRHSNWTVTNTRFSLDEVTLTVGSVKLEIHNGFILGKIQPPRPKMAPAN
DTYESIFSHFREYEIAIRKVPGNFTFTHKKVKHENFSLLTSGEVGEFCVQVKPSVTSRTNKGMWSKEECVSLTRQYF
TVTNVIIFFAFVLLLSGALAYCLALQLYVRRRKKLPRVLLFKKPNAFIFISQRPSPETQDTIHPLDEEAFLKVSPEL
RNSDLHGSTDSGFGSTKPSLQTEEPQFLLPDPHPQADRTLGNGEPPELGDSCSSGSSNSTDSGICLQEPSLSPSTGP
TWEQQVGSDSRGQDDSGIGLVQNSEGQAGDTQGGSALGHDSPPEPEVPAEQDPTAVVFRGYLRQTRCAEEKATKTGC
LEEELPLTGGLGPKFRGCLDDEAGLHPSALAKGYLKQDPLEMTLASSGAPAEQWNQPTEEWSLLALSSCSDLGTSDW
SFAHDLAPLGCVAAPDGLLGSFNSDLVTLPLISSLHE

Cynomolgus IL-10 receptor subunit beta (IL10R1 or IL10RB) sequence (SEQ ID NO:18)
>tr|A0A2K5TJ01
MARSLGSWLGGCLLVSALGMVPPPENVRMNSVNFKNILQWESPAFAKGNLTFTAQYLSYRIFQDKCTSTTLTECDFS
SLSKYGDHTLRVRAEFADEHSDWVNITFCPVDDTIIGPPGMQVEVLADSLHMRFLAPKIENEYETWTMKNVYNSWTY
NVQYWKNGTDEKFQITPQYDFEVLRNLEPWTTYCVQVQGFLPDRNKTGEWSEPVCEKTTSDETVPSWMVAIILMASV
FVVCLALLGCFALLWCIYKKTKYTFSPGNSLPQHLKEFSFPFSDENDVFDKLSVIAEDSESSKQNPDDSCSLGTPSG
QGPQS

Figure 4

Viral IL-10 homolog precursor sequence (SEQ ID NO:19)
>sp|P03180
MERRLVVTLQCLVLLYLAPECGGTDQCDNFPQMLRDLRDAFSRVKTFFQTKDEVDNLLLKESLLEDFKGYLGCQALS
EMIQFYLEEVMPQAENQDPEAKDHVNSLGENLKTLRLRLRRCHRFLPCENKSKAVEQIKNAFNKLQEKGIYKAMSEF
DIFINYIEAYMTIKAR

Viral IL-10 homolog mature form sequence (SEQ ID NO:20)

>sp|P03180|24-170
TDQCDNFPQMLRDLRDAFSRVKTFFQTKDEVDNLLLKESLLEDFKGYLGCQALSEMIQFYLEEVMPQAENQDPEAKD
HVNSLGENLKTLRLRLRRCHRFLPCENKSKAVEQIKNAFNKLQEKGIYKAMSEFDIFINYIEAYMTIKAR

Figure 5A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

Figure 5B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

Figure 5C

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

Figure 5D

| Monomer 1 | Monomer 2 |
| --- | --- |
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |

Figure 5E

| Monomer 1 | Monomer 2 |
|---|---|
| K392D/K409D | E356K/D399K |
| K370D/K392D/K409D | E356K/E357K/D399K |
| K247Q/R355Q/N384S/K392N/V397M/Q419E/K447_ | P217R/P228R/N276K |
| K247Q/R355Q/N384S/K392N/V397M/Q419E/K447_ | N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| K247Q/R355Q/Q419E/K447_ | P217R/P228R/N276K |
| K247Q/R355Q/Q419E/K447_ | N276K |
| K274Q/R355Q/N384S/K392N/V397M/Q419E/K447_ | |
| Q295E/N384D/Q418E/N421D | |
| Q295E/Q418E/N421D | |
| P217R/P228R/N276K | |
| N276K | |
| E269Q/E272Q/E283Q/E357Q | |
| E269Q/E272Q/E283Q | |
| E269Q/E272Q | |
| E269Q/E283Q | |
| E272Q/E283Q | |
| E269Q | |

Figure 6

| Variant constant region | Substitutions |
|---|---|
| pI-ISO(-) | I199T/N203D/K274Q/R355Q/N384S/K392N/N397M/Q419E/K447_ |
| pI_ISO(-)-Fc only | K274Q/R355Q/N384S/K392N/V397M/Q419E/K447_ |
| pI_(-)_isosteric_A | N208D/Q295E/N384D/Q418E/N421D |
| pI_(-)_isosteric A-Fc only | Q295E/N384D/Q418E/N421D |
| pI_(-)_isosteric_B | N208D/Q295E/Q418E/N421D |
| pI_(-)_isosteric_B-Fc only | Q295E/Q418E/N421D |
| pI_ISO(+RR) | Q196K/I199T/P217R/P228R/N276K |
| pI_ISO(+RR)-Fc only | P217R/P228R/N276K |
| pI_ISO(+) | Q196K/I199T/N276K |
| pI_ISO(+)-Fc only | N276K |
| pI_(+)_isosteric_A | E269Q/E272Q/E283Q/E357Q |
| pI_(+)_isosteric_B | E269Q/E272Q/E283Q |
| pI_(+)_isosteric_E269Q/E272Q | E269Q/E272Q |
| pI_(+)_isosteric_E269Q/E283Q | E269Q/E283Q |
| pI_(+)_isosteric_E272Q/E283Q | E272Q/E283Q |
| pI_(+)_isosteric_E269Q | E269Q |

Figure 7

Ablation Variants
G236R
S239G
S239K
S239Q
S239R
V266D
S267K
S267R
H268K
E269R
299R
299K
K322A
A327G
A327L
A327N
A327Q
L328E
P329K
A330L
A330S/P331S
I332K
I332R
V266D/A327Q
V266D/P329K
S267R/A327Q
S267R/P329K
G236R/L328R
E233P/L234V/L235A/G236_/S239K
E233P/L234V/L235A/G236_/S267K
E233P/L234V/L235A/G236_/S239K/A327G
E233P/L234V/L235A/G236_/S267K/A327G
E233P/L234V/L235A/G236_
S239K/S267K
267K/P329K

Figure 8

| Monomer 1 (-) | Monomer 2 (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 9

| Monomer 1 (-) | Monomer 2 (+) |
|---|---|
|  | C220S |
| Heterodimer pI variants L368D/K370S | Heterodimer pI variants S364K/E357Q |
| Isosteric pI substitutions N208D/Q295E/N384D/Q418E/N421D |  |
| FcKO E233P/L234V/L235A/G236_/S267K | FcKO E233P/L234V/L235A/G236_/S267K |
| ±M428L/N434S | ±M428L/N434S |

| Monomer 1 (-) | Monomer 2 (+) |
|---|---|
| C220S |  |
| Heterodimer pI variants L368D/K370S | Heterodimer pI variants S364K/E357Q |
| Isosteric pI substitutions Q295E/N384D/Q418E/N421D |  |
| FcKO E233P/L234V/L235A/G236_/S267K | FcKO E233P/L234V/L235A/G236_/S267K |
| ±M428L/N434S | ±M428L/N434S |

| Monomer 1 (-) | Monomer 2 (+) |
|---|---|
| C220S | C220S |
| Heterodimer pI variants L368D/K370S | Heterodimer pI variants S364K/E357Q |
| Isosteric pI substitutions N208D/Q295E/N384D/Q418E/N421D |  |
| FcKO E233P/L234V/L235A/G236_/S267K | FcKO E233P/L234V/L235A/G236_/S267K |
| ±M428L/N434S | ±M428L/N434S |

| Monomer 1 (-) | Monomer 2 (+) |
|---|---|
| Heterodimer pI variants L368D/K370S | Heterodimer pI variants S364K/E357Q |
| Isosteric pI substitutions N208D/Q295E/N384D/Q418E/N421D |  |
| FcKO E233P/L234V/L235A/G236_/S267K | FcKO E233P/L234V/L235A/G236_/S267K |
| ±M428L/N434S | ±M428L/N434S |

Figure 10

Homodimeric Fc Backbone 1 (SEQ ID NO: 48)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLTCLVK
GFYPSDIAVEWESNGQPENNYKTTPPVLDSDGSFFLYSKLTVDKSRWQQGNVFSCSVMHEALHNHYTQKSLSLSPGK

Homodimeric Fc Backbone 2 (SEQ ID NO: 49)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSRDELTKNQVSLTCLVK
GFYPSDIAVEWESNGQPENNYKTTPPVLDSDGSFFLYSKLTVDKSRWQQGNVFSCSVMHEALHNHYTQKSLSLSPGK

Homodimeric Fc Backbone 3 (SEQ ID NO: 50)
ESKYGPPCPPCPAPEFLGGPSVFLFPPKPKDTLMISRTPEVTCVVVDVSQEDPEVQFNWYVDGVEVHNAKTKPREEQ
FNSTYRVVSVLTVLHQDWLNGKEYKCKVSNKGLPSSIEKTISKAKGQPREPQVYTLPPSQEEMTKNQVSLTCLVKGF
YPSDIAVEWESNGQPENNYKTTPPVLDSDGSFFLYSRLTVDKSRWQEGNVFSCSVMHEALHNHYTQKSLSLSLGK

Homodimeric Fc Backbone 4 (SEQ ID NO: 51)
ERKCCVECPPCPAPPVAGPSVFLFPPKPKDTLMISRTPEVTCVVVDVKHEDPEVQFNWYVDGVEVHNAKTKPREEQF
NSTFRVVSVLTVVHQDWLNGKEYKCKVSNKGLPAPIEKTISKTKGQPREPQVYTLPPSREEMTKNQVSLTCLVKGFY
PSDIAVEWESNGQPENNYKTTPPMLDSDGSFFLYSKLTVDKSRWQQGNVFSCSVMHEALHNHYTQKSLSLSPGK

Figure 11A

Heterodimeric Fc Backbone 1

>Heterodimeric Fc Backbone 1 monomer 1 (SEQ ID NO: 52)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>Heterodimeric Fc Backbone 1 monomer 2 (SEQ ID NO: 53)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Heterodimeric Fc Backbone 2

>Heterodimeric Fc Backbone 2 monomer 1 (SEQ ID NO: 54)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>Heterodimeric Fc Backbone monomer 2 (SEQ ID NO: 55)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Heterodimeric Fc Backbone 3

>Heterodimeric Fc Backbone 3 monomer 1 (SEQ ID NO: 56)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>Heterodimeric Fc Backbone 3 monomer 2 (SEQ ID NO: 57)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCEVS
GFYPSDIAVEWESDGQPENNYKTTPPVLDSDGSFFLYSKLTVDKSRWEQGDVFSCSVMHEALHNHYTQKSLSLSPGK

Heterodimeric Fc Backbone 4

>Heterodimeric Fc Backbone 4 monomer 1 (SEQ ID NO: 58)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLTCLVK
GFYPSDIAVEWESNGQPENNYKTTPPVLDSKGSFFLYSKLTVDKSRWQQGNVFSCSVMHEALHNHYTQKSLSLSPGK

>Heterodimeric Fc Backbone 4 monomer 2 (SEQ ID NO: 59)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTENEVSLTCLVK
GFYPSDIAVEWESDGQPENNYKTTPPVLDSDGSFFLYSKLEVDKSRWEQGDVFSCSVMHEALHNHYTQKSLSLSPGK

Figure 11B

Heterodimeric Fc Backbone 5

>Heterodimeric Fc Backbone 5 monomer 1 (SEQ ID NO: 60)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSRDQLTKNQVKLTCLVK
GFYPSDIAVEWESNGQPENNYKTTPPVLDSDGSFFLYSKLTVDKSRWQQGNVFSCSVMHEALHNHYTQKSLSLSPGK >Heterodimeric Fc Backbone 5 monomer 2 (SEQ ID NO: 61)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSRDELTKNQVSLTCDVS
GFYPSDIAVEWESDGQPENNYKTTPPVLDSDGSFFLYSKLTVDKSRWEQGDVFSCSVMHEALHNHYTQKSLSLSPGK

Heterodimeric Fc Backbone 6

>Heterodimeric Fc Backbone 6 monomer 1 (SEQ ID NO: 62)
EPKSSDKTHTCPPCPAPPVAGPSVFLFPPKPKDTLMISRTPEVTCVVVDVKHEDPEVKFNWYVDGVEVHNAKTKPRE
EQYASTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK >Heterodimeric Fc Backbone 6 monomer 2 (SEQ ID NO: 63)
EPKSSDKTHTCPPCPAPPVAGPSVFLFPPKPKDTLMISRTPEVTCVVVDVKHEDPEVKFNWYVDGVEVHNAKTKPRE
EEYASTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Heterodimeric Fc Backbone 7

>Heterodimeric Fc Backbone 7 monomer 1 (SEQ ID NO: 64)
EPKSSDKTHTCPPCPAPPVAGPSVFLFPPKPKDTLMISRTPEVTCVVVDVKHEDPEVKFNWYVDGVEVHNAKTKPRE
EQYSSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK >Heterodimeric Fc Backbone 7 monomer 2 (SEQ ID NO: 65)
EPKSSDKTHTCPPCPAPPVAGPSVFLFPPKPKDTLMISRTPEVTCVVVDVKHEDPEVKFNWYVDGVEVHNAKTKPRE
EEYSSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Heterodimeric Fc Backbone 8

>Heterodimeric Fc Backbone 8 monomer 1 (SEQ ID NO: 66)
ESKYGPPCPPCPAPEFLGGPSVFLFPPKPKDTLMISRTPEVTCVVVDVSQEDPEVQFNWYVDGVEVHNAKTKPREEQ
FNSTYRVVSVLTVLHQDWLNGKEYKCKVSNKGLPSSIEKTISKAKGQPREPQVYTLPPSQEQMTKNQVKLTCLVKGF
YPSDIAVEWESNGQPENNYKTTPPVLDSDGSFFLYSRLTVDKSRWQEGNVFSCSVMHEALHNHYTQKSLSLSLGK >Heterodimeric Fc Backbone 8 monomer 2 (SEQ ID NO: 67)
ESKYGPPCPPCPAPEFLGGPSVFLFPPKPKDTLMISRTPEVTCVVVDVSQEDPEVQFNWYVDGVEVHNAKTKPREEE
FNSTYRVVSVLTVLHQDWLNGKEYKCKVSNKGLPSSIEKTISKAKGQPREPQVYTLPPSQEEMTKNQVSLTCDVSGF
YPSDIAVEWESDGQPENNYKTTPPVLDSDGSFFLYSRLTVDKSRWEEGDVFSCSVMHEALHNHYTQKSLSLSLGK

Figure 11C

Heterodimeric Fc Backbone 9

\>Heterodimeric Fc Backbone 9 monomer 1 (SEQ ID NO: 68)
ERKCCVECPPCPAPPVAGPSVFLFPPKPKDTLMISRTPEVTCVVVDVSHEDPEVQFNWYVDGVEVHNAKTKPREEQF
NSTFRVVSVLTVVHQDWLNGKEYKCKVSNKGLPAPIEKTISKTKGQPREPQVYTLPPSREQMTKNQVKLTCLVKGFY
PSDIAVEWESNGQPENNYKTTPPMLDSDGSFFLYSKLTVDKSRWQQGNVFSCSVMHEALHNHYTQKSLSLSPGK \>Heterodimeric Fc Backbone 9 monomer 2 (SEQ ID NO: 69)
ERKCCVECPPCPAPPVAGPSVFLFPPKPKDTLMISRTPEVTCVVVDVSHEDPEVQFNWYVDGVEVHNAKTKPREEEF
NSTFRVVSVLTVVHQDWLNGKEYKCKVSNKGLPAPIEKTISKTKGQPREPQVYTLPPSREEMTKNQVSLTCDVSGFY
PSDIAVEWESDGQPENNYKTTPPMLDSDGSFFLYSKLTVDKSRWEQGDVFSCSVMHEALHNHYTQKSLSLSPGK

Heterodimeric Fc Backbone 10

\>Heterodimeric Fc Backbone 10 monomer 1 (SEQ ID NO: 70)
ERKCCVECPPCPAPPVAGPSVFLFPPKPKDTLMISRTPEVTCVVVDVKHEDPEVQFNWYVDGVEVHNAKTKPREEQF
NSTFRVVSVLTVVHQDWLNGKEYKCKVSNKGLPAPIEKTISKTKGQPREPQVYTLPPSREQMTKNQVKLTCLVKGFY
PSDIAVEWESNGQPENNYKTTPPMLDSDGSFFLYSKLTVDKSRWQQGNVFSCSVMHEALHNHYTQKSLSLSPGK \>Heterodimeric Fc Backbone 10 monomer 2 (SEQ ID NO: 71)
ERKCCVECPPCPAPPVAGPSVFLFPPKPKDTLMISRTPEVTCVVVDVKHEDPEVQFNWYVDGVEVHNAKTKPREEEF
NSTFRVVSVLTVVHQDWLNGKEYKCKVSNKGLPAPIEKTISKTKGQPREPQVYTLPPSREEMTKNQVSLTCDVSGFY
PSDIAVEWESDGQPENNYKTTPPMLDSDGSFFLYSKLTVDKSRWEQGDVFSCSVMHEALHNHYTQKSLSLSPGK

Heterodimeric Fc Backbone 11

\>Heterodimeric Fc Backbone 11 monomer 1 (SEQ ID NO: 72)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVLHEALHSHYTQKSLSLSPGK \>Heterodimeric Fc Backbone 11 monomer 2 (SEQ ID NO: 73)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVLHEALHSHYTQKSLSLSPGK

Heterodimeric Fc Backbone 12

\>Heterodimeric Fc Backbone 12 monomer 1 (SEQ ID NO: 74)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK \>Heterodimeric Fc Backbone 12 monomer 2 (SEQ ID NO: 75)
ERKSSDKTHTCPRCPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 12

> IgG1 CH1 + partial hinge (+ side) (SEQ ID NO: 76)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKV

> IgG2 CH1 + partial hinge (+ side) (SEQ ID NO: 77)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSNTKVDKTV

> IgG4 CH1 + partial hinge (+ side) (SEQ ID NO: 78)
ASTKGPSVFPLAPCSRSTSESTAALGCLVKDYFPEPVTVSWNSGALTSGVHTFPAVLQSSGLYSLSSVVTVPSSSLG
TKTYTCNVDHKPSNTKVDKRV

> IgG1 CH1 + partial hinge (- side) (SEQ ID NO: 79)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKV

> IgG2 CH1 + partial hinge (- side) (SEQ ID NO: 80)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSDTKVDKTV

> IgG4 CH1 + partial hinge (- side) (SEQ ID NO: 81)
ASTKGPSVFPLAPCSRSTSESTAALGCLVKDYFPEPVTVSWNSGALTSGVHTFPAVLQSSGLYSLSSVVTVPSSSLG
TKTYTCNVDHKPSDTKVDKRV

Figure 13

Constant Light Chain – Kappa (SEQ ID NO: 82)
RTVAAPSVFIFPPSDEQLKSGTASVVCLLNNFYPREAKVQWKVDNALQSGNSQESVTEQDSKDSTYSLSSTLTLSKA
DYEKHKVYACEVTHQGLSSPVTKSFNRGEC

Constant Light Chain – Lambda (SEQ ID NO: 83)
GQPKAAPSVTLFPPSSEELQANKATLVCLISDFYPGAVTVAWKADSSPVKAGVETTTPSKQSNNKYAASSYLSLTPE
QWKSHRSYSCQVTHEGSTVEKTVAPTECS Figure 14A-Figure 14F
Figure 14A
hIL-10(A-D) Domain
Figure 14B
hIL-10(E-F) Domain
Figure 14C
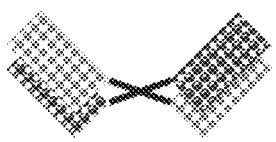
IL-10 Homodimer
Figure 14D
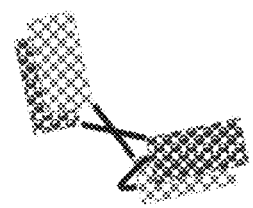
scIL-10
Figure 14E
IL10M1
Figure 14F
splitIL-10

Figure 15A
hIL-10(A-D) (SEQ ID NO:21)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCEN

Figure 15B
hIL-10(E-F) (SEQ ID NO:22)
KSKAVEQVKNAFNKLQEKGIYKAMSEFDIFINYIEAYMTMKIRN

Figure 15C
scIL-10 (SEQ ID NO:23)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIRN

Figure 15D
IL10M1 (SEQ ID NO:24)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

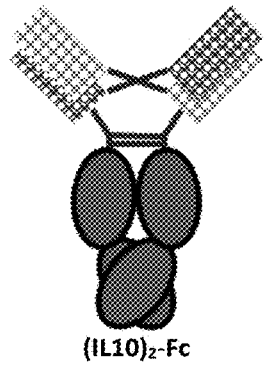

(IL10)₂-Fc
Example: XENP24628

Figure 16B

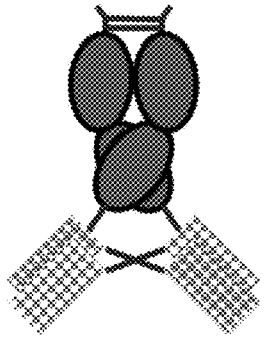

Fc-(IL10)₂
Example: XENP24632

Figure 16C

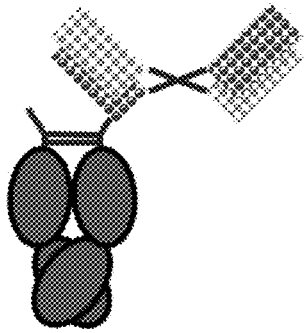

(IL10-NC-IL10)-heteroFc
Example: XENP25955

Figure 16D

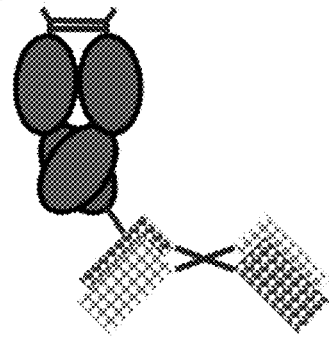

heteroFc-(IL10-NC-IL10)

Figure 17

>XENP24628_huIL10_Fc(216)_IgG1_PVA_/S267K (SEQ ID NO: 84)

*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN*/EPKSSDKTHTCPPCPAPPVAGPSVFLFPPKPKDTLMISRTPEVTCVVVDVKHEDPEVKFNWYVDGVEVHN
AKTKPREEQYNSTYRVVSVLTVLHQDWLNGKEYKCKVSNKALPAPIEKTISKAKGQPREPQVYTLPPSREEMTKNQV
SLTCLVKGFYPSDIAVEWESNGQPENNYKTTPPVLDSDGSFFLYSKLTVDKSRWQQGNVFSCSVMHEALHNHYTQKS
LSLSPGK

>XENP24629_huIL10_(G4S)_Fc(216)_IgG1_PVA_/S267K (SEQ ID NO: 85)

*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN*/<u>GGGGS</u>/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREE
MTKNQVSLTCLVKGFYPSDIAVEWESNGQPENNYKTTPPVLDSDGSFFLYSKLTVDKSRWQQGNVFSCSVMHEALHN
HYTQKSLSLSPGK

>XENP24630_huIL10_(G4S)2_Fc(216)_IgG1_PVA_/S267K (SEQ ID NO: 86)

*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN*/<u>GGGGSGGGGS</u>/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREEMTKNQVSLTCLVKGFYPSDIAVEWESNGQPENNYKTTPPVLDSDGSFFLYSKLTVDKSRWQQGNVFSCSVMH
EALHNHYTQKSLSLSPGK

>XENP24631_huIL10_(G4S)3_Fc(216)_IgG1_PVA_/S267K (SEQ ID NO: 87)

*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN*/<u>GGGGSGGGGSGGGGS</u>/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREEMTKNQVSLTCLVKGFYPSDIAVEWESNGQPENNYKTTPPVLDSDGSFFLYSKLTVDKSRWQQGNVFS
CSVMHEALHNHYTQKSLSLSPGK

Figure 18

>XENP24632 empty-Fc(216-446)_IgG1_C220S/PVA_/S267K_(G4S)_huIL-10 (SEQ ID NO: 88)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLTCLVK
GFYPSDIAVEWESNGQPENNYKTTPPVLDSDGSFFLYSKLTVDKSRWQQGNVFSCSVMHEALHNHYTQKSLSLSPG/
GGGGS/*SPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN*

>XENP24633 empty-Fc(216-446)_IgG1_C220S/PVA_/S267K_(G4S)2_huIL-10 (SEQ ID NO: 89)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLTCLVK
GFYPSDIAVEWESNGQPENNYKTTPPVLDSDGSFFLYSKLTVDKSRWQQGNVFSCSVMHEALHNHYTQKSLSLSPG/
GGGGSGGGGS/*SPGQGTQSENSCTHFPGNLPNMLRDLRDAFSRVKTFFQMKDQLDNLLLKESLLEDFKGYLGCQALS
EMIQFYLEEVMPQAENQDPDIKAHVNSLGENLKTLRLRLRRCLRFLPCENKSKAVEQVKNAFNKLQEKGIYKAMSEF
DIFINYIEAYMTMKIRN*

>XENP24634 empty-Fc(216-446)_IgG1_C220S/PVA_/S267K_(G4S)3_huIL-10 (SEQ ID NO: 90)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLTCLVK
GFYPSDIAVEWESNGQPENNYKTTPPVLDSDGSFFLYSKLTVDKSRWQQGNVFSCSVMHEALHNHYTQKSLSLSPG/
GGGGSGGGGSGGGGS/*SPGQGTQSENSCTHFPGNLPNMLRDLRDAFSRVKTFFQMKDQLDNLLLKESLLEDFKGYLG
CQALSEMIQFYLEEVMPQAENQDPDIKAHVNSLGENLKTLRLRLRRCLRFLPCENKSKAVEQVKNAFNKLQEKGIYK
AMSEFDIFINYIEAYMTMKIRN*

Figure 19

>XENP25955 empty_Fc-huIL10_huIL10(non-covalent)_(G4S)2-Fc(216)_IgG1_pI(-)_Isosteric_A_C220S/PVA_/S267KL368D/K370S-Fc(216)_IgG1_C220S/PVA_/S267K/S364K/E357Q

XENP25955 Chain 1 - empty_Fc(216)_IgG1_pI(-)_Isosteric_A_C220S/PVA_/S267KL368D/K370S (SEQ ID NO: 91)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

XENP25955 Chain 2 - huIL10_(G4S)2-Fc(216)_IgG1_C220S/PVA_/S267K/S364K/E357Q (SEQ ID NO: 92)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN*/EPKSSDKTHTCPPCPAPPVAGPSVFLFPPKPKDTLMISRTPEVTCVVVDVKHEDPEVKFNWYVDGVEVHN
AKTKPREEQYNSTYRVVSVLTVLHQDWLNGKEYKCKVSNKALPAPIEKTISKAKGQPREPQVYTLPPSREQMTKNQV
KLTCLVKGFYPSDIAVEWESNGQPENNYKTTPPVLDSDGSFFLYSKLTVDKSRWQQGNVFSCSVMHEALHNHYTQKS
LSLSPGK

XENP25955 Chain 3 - huIL10 (SEQ ID NO: 93)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN*

Figure 20A-Figure 20B
Figure 20A
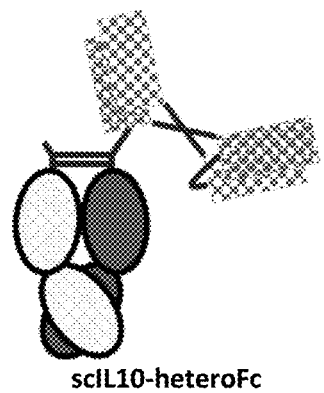
scIL10-heteroFc
Example: XENP25238
Figure 20B
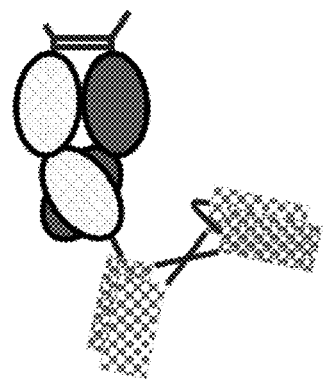
heteroFc-scIL10
Example: XENP28740

Figure 21A

>XENP25238_huIL10_huIL10_(G4S)2-empty_Fc(216)_IgG1_pI(-)_Isosteric_A_C220S/PVA_/S267K/L368D/K370S-IgG1_C220S/PVA_/S267K/S364K/E357Q XENP25238 Chain 1 - huIL10_huIL10_(G4S)2_Fc(216)_IgG1_pI(-)_Isosteric_A_C220S/PVA_/S267K/L368D/K370S (SEQ ID NO: 94)

*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN/GGGGSGGGGS/EPKSSDKTHTCPPCPAPPVAGPSVFLFPPKPKDTLMISRTPEVTCVVVDVKHE
DPEVKFNWYVDGVEVHNAKTKPREEEYNSTYRVVSVLTVLHQDWLNGKEYKCKVSNKALPAPIEKTISKAKGQPREP
QVYTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*

XENP25238 Chain 2 - empty_Fc(216)_IgG1_C220S/PVA_/S267K/S364K/E357Q (SEQ ID NO: 95)

EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>XENP25239_huIL10_(G4S)_huIL10_(G4S)2-empty_Fc(216)_IgG1_pI(-)_Isosteric_A_C220S/PVA_/S267K/L368D/K370S-IgG1_C220S/PVA_/S267K/S364K/E357Q XENP25239 Chain 1 - huIL10_(G4S)_huIL10_(G4S)2_Fc(216)_IgG1_pI(-)_Isosteric_A_C220S/PVA_/S267K/L368D/K370S (SEQ ID NO: 96)

*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN/GGGGS/SPGQGTQSENSCTHFPGNLPNMLRDLRDAFSRVKTFFQMKDQLDNLLLKESLLEDFKGYLGCQA
LSEMIQFYLEEVMPQAENQDPDIKAHVNSLGENLKTLRLRLRRCLRFLPCENKSKAVEQVKNAFNKLQEKGIYKAMS
EFDIFINYIEAYMTMKIRN/GGGGSGGGGS/EPKSSDKTHTCPPCPAPPVAGPSVFLFPPKPKDTLMISRTPEVTCV
VVDVKHEDPEVKFNWYVDGVEVHNAKTKPREEEYNSTYRVVSVLTVLHQDWLNGKEYKCKVSNKALPAPIEKTISKA
KGQPREPQVYTLPPSREEMTKNQVSLTCDVSGFYPSDIAVEWESDGQPENNYKTTPPVLDSDGSFFLYSKLTVDKSR
WEQGDVFSCSVMHEALHNHYTQKSLSLSPGK*

XENP25239 Chain 2 - empty_Fc(216)_IgG1_C220S/PVA_/S267K/S364K/E357Q (SEQ ID NO: 97)

EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 21B

>XENP25240 huIL10_(G4S)2_huIL10_(G4S)2-empty_Fc(216)_IgG1_pI(-
)_Isosteric_A_C220S/PVA_/S267K/L368D/K370S-IgG1_C220S/PVA_/S267K/S364K/E357Q XENP25240 Chain 1 - huIL10_(G4S)2_huIL10_(G4S)2_Fc(216)_IgG1_pI(-
)_Isosteric_A_C220S/PVA_/S267K/L368D/K370S  (SEQ ID NO: 98)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN/<u>GGGGSGGGGS</u>/SPGQGTQSENSCTHFPGNLPNMLRDLRDAFSRVKTFFQMKDQLDNLLLKESLLEDFKGY
LGCQALSEMIQFYLEEVMPQAENQDPDIKAHVNSLGENLKTLRLRLRRCLRFLPCENKSKAVEQVKNAFNKLQEKGI
YKAMSEFDIFINYIEAYMTMKIRN/<u>GGGGSGGGGS</u>/EPKSSDKTHTCPPCPAPPVAGPSVFLFPPKPKDTLMISRTP
EVTCVVVDVKHEDPEVKFNWYVDGVEVHNAKTKPREEEYNSTYRVVSVLTVLHQDWLNGKEYKCKVSNKALPAPIEK
TISKAKGQPREPQVYTLPPSREEMTKNQVSLTCDVSGFYPSDIAVEWESDGQPENNYKTTPPVLDSDGSFFLYSKLT
VDKSRWEQGDVFSCSVMHEALHNHYTQKSLSLSPGK*

XENP25240 Chain 2 - empty_Fc(216)_IgG1_C220S/PVA_/S267K/S364K/E357Q  (SEQ ID NO: 99)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK >XENP25241 huIL10_(G4S)3_huIL10_(G4S)2-empty_Fc(216)_IgG1_pI(-
)_Isosteric_A_C220S/PVA_/S267K/L368D/K370S-IgG1_C220S/PVA_/S267K/S364K/E357Q XENP25241 Chain 1 - huIL10_(G4S)3_huIL10_(G4S)2_Fc(216)_IgG1_pI(-
)_Isosteric_A_C220S/PVA_/S267K/L368D/K370S (SEQ ID NO: 100)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN/<u>GGGGSGGGGSGGGGS</u>/SPGQGTQSENSCTHFPGNLPNMLRDLRDAFSRVKTFFQMKDQLDNLLLKESLLE
DFKGYLGCQALSEMIQFYLEEVMPQAENQDPDIKAHVNSLGENLKTLRLRLRRCLRFLPCENKSKAVEQVKNAFNKL
QEKGIYKAMSEFDIFINYIEAYMTMKIRN/<u>GGGGSGGGGS</u>/EPKSSDKTHTCPPCPAPPVAGPSVFLFPPKPKDTLM
ISRTPEVTCVVVDVKHEDPEVKFNWYVDGVEVHNAKTKPREEEYNSTYRVVSVLTVLHQDWLNGKEYKCKVSNKALP
APIEKTISKAKGQPREPQVYTLPPSREEMTKNQVSLTCDVSGFYPSDIAVEWESDGQPENNYKTTPPVLDSDGSFFL
YSKLTVDKSRWEQGDVFSCSVMHEALHNHYTQKSLSLSPGK*

XENP25241 Chain 2 - empty_Fc(216)_IgG1_C220S/PVA_/S267K/S364K/E357Q (SEQ ID NO: 101)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 21C

>XENP25880 empty_Fc(216)-huIL10_huIL10_(G4S)2_IgG1_pI(-)_Isosteric_A_C220S/PVA_/S267K/L368D/K370S-IgG1_C220S/PVA_/S267K/S364K/E357Q XENP25880 Chain 1 - empty_Fc(216)_IgG1_pI(-)_Isosteric_A_C220S/PVA_/S267K/L368D/K370S (SEQ ID NO: 102)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP25880 Chain 2 - huIL10_huIL10_(G4S)2_IgG1_C220S/PVA_/S267K/S364K/E357Q (SEQ ID NO: 103)
*SPGQGTQSENSCTHFPGNLPNMLRDLRDAFSRVKTFFQMKDQLDNLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIEAYM*
*TMKIRNSPGQGTQSENSCTHFPGNLPNMLRDLRDAFSRVKTFFQMKDQLDNLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTMKIRN*/<u>GGGGSGGGGS</u>/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP28295 empty-huIL10_huIL10-Fc(216)_IgG1_pI(-)_Isosteric_A_PVA_/S267K/L368D/K370S-Fc(216)_IgG1_C220S/PVA_/S267K/S364K/E357Q XENP28295 Chain 1 - empty_Fc(216)_IgG1_pI(-)_Isosteric_A_PVA_/S267K/L368D/K370S (SEQ ID NO: 104)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP28295 Chain 2 - huIL10_huIL10_Fc(216)_IgG1_C220S/PVA_/S267K/S364K/E357Q (SEQ ID NO: 105)
*SPGQGTQSENSCTHFPGNLPNMLRDLRDAFSRVKTFFQMKDQLDNLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIEAYM*
*TMKIRNSPGQGTQSENSCTHFPGNLPNMLRDLRDAFSRVKTFFQMKDQLDNLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 22

>XENP28740_empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10_huIL10

Chain 1 - empty_Fc(216)_pI(-)_Isosteric_A_C220S/PVA_/S267K/L368D/K370S (SEQ ID NO: 106)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - Fc(216)_IgG1_C220S/PVA_/S267K/S364K/E357Q/K447del_(G4S)3_huIL10_huIL10 (SEQ ID NO: 107)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG\
GGGGSGGGGSGGGGS\SPGQGTQSENSCTHFPGNLPNMLRDLRDAFSRVKTFFQMKDQLDNLLLKESLLEDFKGYLG
CQALSEMIQFYLEEVMPQAENQDPDIKAHVNSLGENLKTLRLRLRRCLRFLPCENKSKAVEQVKNAFNKLQEKGIYK
AMSEFDIFINYIEAYMTMKIRNSPGQGTQSENSCTHFPGNLPNMLRDLRDAFSRVKTFFQMKDQLDNLLLKESLLED
FKGYLGCQALSEMIQFYLEEVMPQAENQDPDIKAHVNSLGENLKTLRLRLRRCLRFLPCENKSKAVEQVKNAFNKLQ
EKGIYKAMSEFDIFINYIEAYMTMKIRN Figure 23A-Figure 23F
Figure 23A)
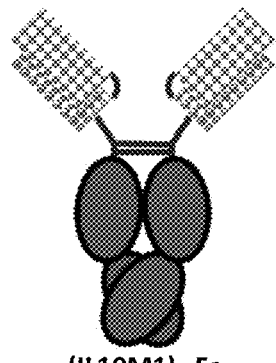
(IL10M1)₂-Fc
Example: XENP25326
Figure 23B)
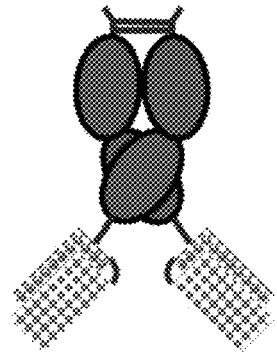
Fc-(IL10M1)₂
Example: XENP25327
Figure 23C)
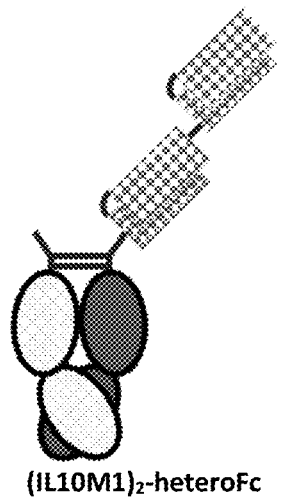
(IL10M1)₂-heteroFc
Figure 23D)
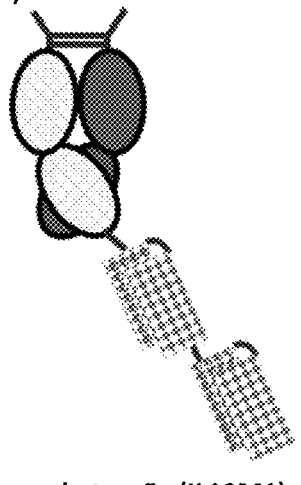
heteroFc-(IL10M1)₂
Figure 23E)
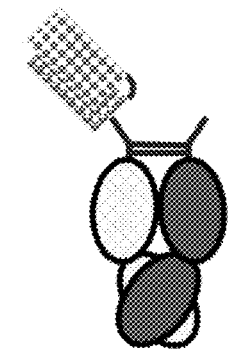
(IL10M1)₁-heteroFc
Figure 23F)
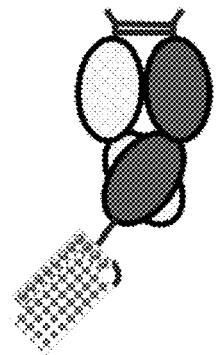
heteroFc-(IL10M1)₁

Figure 24

>XENP14246 empty-Fc(216)-huIL10M1_Fc(216)_IgG1_PVA_/S267K_pI(-)_Isosteric_A_L368D/K370S-IgG1_C220S/S364K/E357Q XENP14246 Chain 1 - empty-Fc(216)_IgG1_PVA_/S267K_pI(-)_Isosteric_A_L368D/K370S (SEQ ID NO: 108)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP14246 Chain 2 - huIL10M1_Fc(216)_IgG1_C220S/S364K/E357Q (SEQ ID NO: 109)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 25

XENP14247 empty-Fc(216)-empty-Fc(216)_IgG1_PVA_/S267K_pI(-)_Isosteric_A_L368D/K370S-IgG1_C220S/S364K/E357Q_(G4S)3_huIL10M1

XENP14247 Chain 1 - empty-Fc(216)_IgG1_PVA_/S267K_pI(-)_Isosteric_A_L368D/K370S (SEQ ID NO: 110)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP14247 Chain 2 - Fc(216)_IgG1_C220S/S364K/E357Q_(G4S)3_huIL10M1 (SEQ ID NO: 111)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK
/<u>GGGGSGGGGSGGGGS</u>/*SPGQGTQSENSCTHFPGNLPNMLRDLRDAFSRVKTFFQMKDQLDNLLLKESLLEDFKGYL
GCQALSEMIQFYLEEVMPQAENQDPDIKAHVNSLGENLKTLRLRLRRCHRFLPCENGGGSGGKSKAVEQVKNAFNKL
QEKGIYKAMSEFDIFINYIEAYMTMKIRN*

Figure 26

>XENP25236 huIL10M1_Fc(216)_IgG1_C220S/PVA_/S267K (SEQ ID NO: 112)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREE
MTKNQVSLTCLVKGFYPSDIAVEWESNGQPENNYKTTPPVLDSDGSFFLYSKLTVDKSRWQQGNVFSCSVMHEALHN
HYTQKSLSLSPGK

Figure 27

>XENP25237 empty-Fc(216)_IgG1_C220S/PVA_/S267K_(G4S)3_huIL10M1_ (SEQ ID NO: 113)

EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLTCLVK
GFYPSDIAVEWESNGQPENNYKTTPPVLDSDGSFFLYSKLTVDKSRWQQGNVFSCSVMHEALHNHYTQKSLSLSPGK
/GGGGSGGGGSGGGGS/SPGQGTQSENSCTHFPGNLPNMLRDLRDAFSRVKTFFQMKDQLDNLLLKESLLEDFKGYL
GCQALSEMIQFYLEEVMPQAENQDPDIKAHVNSLGENLKTLRLRLRRCHRFLPCENGGGSGGKSKAVEQVKNAFNKL
QEKGIYKAMSEFDIFINYIEAYMTMKIRN

Figure 28

>XENP26887 empty-huIL10M1_(G4S)3_huIL10M1_(G4S)2-Fc(216)_IgG1_pI(-
)_Isosteric_A_C220S/PVA_/S267K/L368D/K370S-Fc(222)_IgG1_C220S/PVA_/S267K/S364K/E357Q XENP26887 Chain 1 - empty_Fc(216)_IgG1_pI(-)_Isosteric_A_C220S/PVA_/S267K/L368D/K370S (SEQ ID NO: 114)

EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

XENP26887 Chain 2 - huIL10M1_(G4S)3_huIL10M1_(G4S)2_Fc(222)_IgG1_C220S/PVA_/S267K/S364K/E357Q
(SEQ ID NO: 115)

SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN/GGGGSGGGGSGGGGS/SPGQGTQSENSCTHFPGNLPNMLRDLRDAFSRVKTFFQMKDQLDNLLL
KESLLEDFKGYLGCQALSEMIQFYLEEVMPQAENQDPDIKAHVNSLGENLKTLRLRLRRCHRFLPCENGGGSGGKSK
AVEQVKNAFNKLQEKGIYKAMSEFDIFINYIEAYMTMKIRN/GGGGSGGGGS/KTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKV
SNKALPAPIEKTISKAKGQPREPQVYTLPPSREQMTKNQVKLTCLVKGFYPSDIAVEWESNGQPENNYKTTPPVLDS
DGSFFLYSKLTVDKSRWQQGNVFSCSVMHEALHNHYTQKSLSLSPGK

Figure 29A-Figure 29D
Figure 29A)
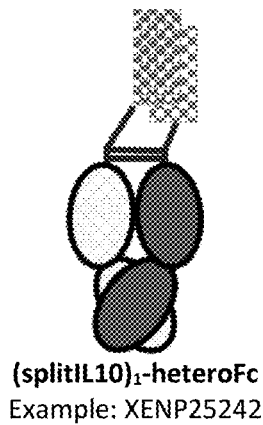
(splitIL10)₁-heteroFc
Example: XENP25242
Figure 29B)
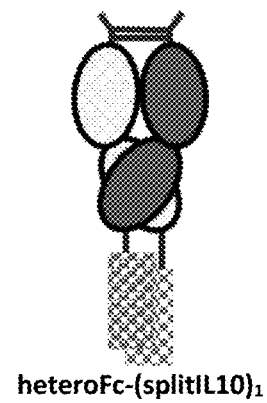
heteroFc-(splitIL10)₁
Figure 29C)
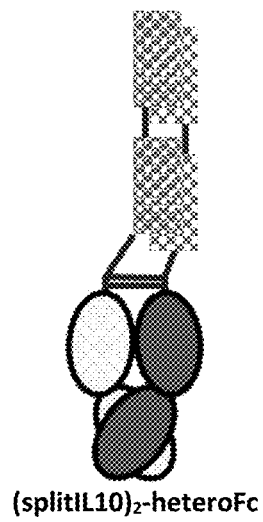
(splitIL10)₂-heteroFc
Figure 29D)
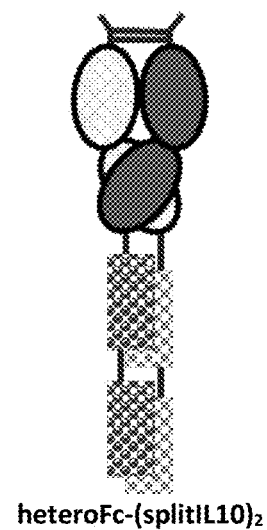
heteroFc-(splitIL10)₂

Figure 30

>XENP25242 huIL10(19-134)-huIL10(135-178)_Fc(216)_IgG1_pI(-)_Isosteric_A_C220S/PVA_/S267K/L368D/K370S-IgG1_C220S/PVA_/S267K/S364K/E357Q

XENP25242 Chain 1 - huIL10(19-134)_Fc(216)_IgG1_pI(-)_Isosteric_A_C220S/PVA_/S267K/L368D/K370S (SEQ ID NO: 116)

*SPGQGTQSENSCTHFPGNLPNMLRDLRDAFSRVKTFFQMKDQLDNLLLKESLLEDFKGYLGCQALSEMIQFYLEEVM PQAENQDPDIKAHVNSLGENLKTLRLRLRRCLRFLPCEN*/EPKSSDKTHTCPPCPAPPVAGPSVFLFPPKPKDTLMI SRTPEVTCVVVDVKHEDPEVKFNWYVDGVEVHNAKTKPREEEYNSTYRVVSVLTVLHQDWLNGKEYKCKVSNKALPA PIEKTISKAKGQPREPQVYTLPPSREEMTKNQVSLTCDVSGFYPSDIAVEWESDGQPENNYKTTPPVLDSDGSFFLY SKLTVDKSRWEQGDVFSCSVMHEALHNHYTQKSLSLSPGK

XENP25242 Chain 2 - huIL10(135-178)_Fc(216)_IgG1_C220S/PVA_/S267K/S364K/E357Q (SEQ ID NO: 117)

*KSKAVEQVKNAFNKLQEKGIYKAMSEFDIFINYIEAYMTMKIRN*/EPKSSDKTHTCPPCPAPPVAGPSVFLFPPKPK DTLMISRTPEVTCVVVDVKHEDPEVKFNWYVDGVEVHNAKTKPREEQYNSTYRVVSVLTVLHQDWLNGKEYKCKVSN KALPAPIEKTISKAKGQPREPQVYTLPPSREQMTKNQVKLTCLVKGFYPSDIAVEWESNGQPENNYKTTPPVLDSDG SFFLYSKLTVDKSRWQQGNVFSCSVMHEALHNHYTQKSLSLSPGK

>XENP25243 huIL10(19-134)_(G4S)-huIL10(135-178)_(G4S)_Fc(216)_IgG1_pI(-)_Isosteric_A_C220S/PVA_/S267K/L368D/K370S-IgG1_C220S/PVA_/S267K/S364K/E357Q

XENP25243 Chain 1 - huIL10(19-134)_(G4S)_Fc(216)_IgG1_pI(-)_Isosteric_A_C220S/PVA_/S267K/L368D/K370S (SEQ ID NO: 118)

*SPGQGTQSENSCTHFPGNLPNMLRDLRDAFSRVKTFFQMKDQLDNLLLKESLLEDFKGYLGCQALSEMIQFYLEEVM PQAENQDPDIKAHVNSLGENLKTLRLRLRRCLRFLPCEN*/GGGGS/EPKSSDKTHTCPPCPAPPVAGPSVFLFPPKP KDTLMISRTPEVTCVVVDVKHEDPEVKFNWYVDGVEVHNAKTKPREEEYNSTYRVVSVLTVLHQDWLNGKEYKCKVS NKALPAPIEKTISKAKGQPREPQVYTLPPSREEMTKNQVSLTCDVSGFYPSDIAVEWESDGQPENNYKTTPPVLDSD GSFFLYSKLTVDKSRWEQGDVFSCSVMHEALHNHYTQKSLSLSPGK

XENP25243 Chain 2 - huIL10(135-178)_(G4S)_Fc(216)_IgG1_C220S/PVA_/S267K/S364K/E357Q (SEQ ID NO: 119)

*KSKAVEQVKNAFNKLQEKGIYKAMSEFDIFINYIEAYMTMKIRN*/GGGGS/EPKSSDKTHTCPPCPAPPVAGPSVFL FPPKPKDTLMISRTPEVTCVVVDVKHEDPEVKFNWYVDGVEVHNAKTKPREEQYNSTYRVVSVLTVLHQDWLNGKEY KCKVSNKALPAPIEKTISKAKGQPREPQVYTLPPSREQMTKNQVKLTCLVKGFYPSDIAVEWESNGQPENNYKTTPP VLDSDGSFFLYSKLTVDKSRWQQGNVFSCSVMHEALHNHYTQKSLSLSPGK

>XENP25244 huIL10(19-134)_(G4S)2-huIL10(135-178)_(G4S)2_Fc(216)_IgG1_pI(-)_Isosteric_A_C220S/PVA_/S267K/L368D/K370S-IgG1_C220S/PVA_/S267K/S364K/E357Q

XENP25244 Chain 1 - huIL10(19-134)_(G4S)2_Fc(216)_IgG1_pI(-)_Isosteric_A_C220S/PVA_/S267K/L368D/K370S (SEQ ID NO: 120)

*SPGQGTQSENSCTHFPGNLPNMLRDLRDAFSRVKTFFQMKDQLDNLLLKESLLEDFKGYLGCQALSEMIQFYLEEVM PQAENQDPDIKAHVNSLGENLKTLRLRLRRCLRFLPCEN*/GGGGSGGGGS/EPKSSDKTHTCPPCPAPPVAGPSVFL FPPKPKDTLMISRTPEVTCVVVDVKHEDPEVKFNWYVDGVEVHNAKTKPREEEYNSTYRVVSVLTVLHQDWLNGKEY KCKVSNKALPAPIEKTISKAKGQPREPQVYTLPPSREEMTKNQVSLTCDVSGFYPSDIAVEWESDGQPENNYKTTPP VLDSDGSFFLYSKLTVDKSRWEQGDVFSCSVMHEALHNHYTQKSLSLSPGK

XENP25244 Chain 2 - huIL10(135-178)_(G4S)2_Fc(216)_IgG1_C220S/PVA_/S267K/S364K/E357Q (SEQ ID NO: 121)

*KSKAVEQVKNAFNKLQEKGIYKAMSEFDIFINYIEAYMTMKIRN*/GGGGSGGGGS/EPKSSDKTHTCPPCPAPPVAGPSVFLFPPK PKDTLMISRTPEVTCVVVDVKHEDPEVKFNWYVDGVEVHNAKTKPREEQYNSTYRVVSVLTVLHQDWLNGKEYKCKVSNKALPAPI EKTISKAKGQPREPQVYTLPPSREQMTKNQVKLTCLVKGFYPSDIAVEWESNGQPENNYKTTPPVLDSDGSFFLYSKLTVDKSRWQ QGNVFSCSVMHEALHNHYTQKSLSLSPGK

Figure 31

>XENP25879 empty-Fc(216-446)-empty-Fc(216-446)_IgG1_PVA_/S267K_pI(-
)_Isosteric_A_L368D/K370S_(G4S)3_huIL10(19-134)-IgG1_C220S/S364K/E357Q_(G4S)3_huIL10(135-178)

XENP25879 Chain 1 - empty-Fc(216-446)_IgG1_PVA_/S267K_pI(-)_Isosteric_A_L368D/K370S_(G4S)3_huIL10(19-
134)  (SEQ ID NO: 122)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPG/
GGGGSGGGGSGGGGS/SPGQGTQSENSCTHFPGNLPNMLRDLRDAFSRVKTFFQMKDQLDNLLLKESLLEDFKGYLG
CQALSEMIQFYLEEVMPQAENQDPDIKAHVNSLGENLKTLRLRLRRCLRFLPCEN XENP25879 Chain 2 - empty-Fc(216-446)_IgG1_C220S/S364K/E357Q_(G4S)3_huIL10(135-178)  (SEQ ID NO: 123)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
GGGGSGGGGSGGGGS/KSKAVEQVKNAFNKLQEKGIYKAMSEFDIFINYIEAYMTMKIRN

Figure 35A

> IL-10(N21D) (SEQ ID NO: 124)
SPGQGTQSENSCTHFPGNLPDMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(D28N) (SEQ ID NO: 125)
SPGQGTQSENSCTHFPGNLPNMLRDLRNAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(Q38E) (SEQ ID NO: 126)
SPGQGTQSENSCTHFPGNLPNMLRDLRDAFSRVKTFFEMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(M39T) (SEQ ID NO: 127)
SPGQGTQSENSCTHFPGNLPNMLRDLRDAFSRVKTFFQTKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(D41N) (SEQ ID NO: 128)
SPGQGTQSENSCTHFPGNLPNMLRDLRDAFSRVKTFFQMKNQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(Q42E) (SEQ ID NO: 129)
SPGQGTQSENSCTHFPGNLPNMLRDLRDAFSRVKTFFQMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(L43V) (SEQ ID NO: 130)
SPGQGTQSENSCTHFPGNLPNMLRDLRDAFSRVKTFFQMKDQVDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(D44N) (SEQ ID NO: 131)
SPGQGTQSENSCTHFPGNLPNMLRDLRDAFSRVKTFFQMKDQLNNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(N45D) (SEQ ID NO: 132)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(I87A) (SEQ ID NO: 133)
SPGQGTQSENSCTHFPGNLPNMLRDLRDAFSRVKTFFQMKDQLDNLLLKESLLEDFKGYLGCQALSEMIQFYLEEVM
PQAENQDPDAKAHVNSLGENLKTLRLRLRRCLRFLPCENKSKAVEQVKNAFNKLQEKGIYKAMSEFDIFINYIEAYM
TMKIRN

> IL-10(E142Q) (SEQ ID NO: 134)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSQFDIFINYIEAYM
TMKIRN

Figure 35B

> IL-10(D144N) (SEQ ID NO: 135)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRN

> IL-10(E151Q) (SEQ ID NO: 136)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIQAYM
TMKIRN

> IL-10(Q38E/D41N) (SEQ ID NO: 137)
SPGQGTQSENSCTHFPGNLPNMLRDLRDAFSRVKTFFEMKNQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(Q38E/Q42E) (SEQ ID NO: 138)
SPGQGTQSENSCTHFPGNLPNMLRDLRDAFSRVKTFFEMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(Q38E/N45D) (SEQ ID NO: 139)
SPGQGTQSENSCTHFPGNLPNMLRDLRDAFSRVKTFFEMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(Q38E/E142Q) (SEQ ID NO: 140)
SPGQGTQSENSCTHFPGNLPNMLRDLRDAFSRVKTFFEMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSQFDIFINYIEAYM
TMKIRN

> IL-10(Q38E/D144N) (SEQ ID NO: 141)
SPGQGTQSENSCTHFPGNLPNMLRDLRDAFSRVKTFFEMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRN

> IL-10(D41N/Q42E) (SEQ ID NO: 142)
SPGQGTQSENSCTHFPGNLPNMLRDLRDAFSRVKTFFQMKNELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(D41N/N45D) (SEQ ID NO: 143)
SPGQGTQSENSCTHFPGNLPNMLRDLRDAFSRVKTFFQMKNQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(D41N/E142Q) (SEQ ID NO: 144)
SPGQGTQSENSCTHFPGNLPNMLRDLRDAFSRVKTFFQMKNQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSQFDIFINYIEAYM
TMKIRN

Figure 35C

> IL-10(D41N/D144N) (SEQ ID NO: 145)
SPGQGTQSENSCTHFPGNLPNMLRDLRDAFSRVKTFFQMKNQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRN

> IL-10(Q42E/N45D) (SEQ ID NO: 146)
SPGQGTQSENSCTHFPGNLPNMLRDLRDAFSRVKTFFQMKDELDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(Q42E/E142Q) (SEQ ID NO: 147)
SPGQGTQSENSCTHFPGNLPNMLRDLRDAFSRVKTFFQMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSQFDIFINYIEAYM
TMKIRN

> IL-10(Q42E/D144N) (SEQ ID NO: 148)
SPGQGTQSENSCTHFPGNLPNMLRDLRDAFSRVKTFFQMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRN

> IL-10(N45D/E142Q) (SEQ ID NO: 149)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSQFDIFINYIEAYM
TMKIRN

> IL-10(N45D/D144N) (SEQ ID NO: 150)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRN

> IL-10(E142Q/D144N) (SEQ ID NO: 151)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSQFNIFINYIEAYM
TMKIRN

> IL-10(N21D/Q42E) (SEQ ID NO: 152)
SPGQGTQSENSCTHFPGNLPDMLRDLRDAFSRVKTFFQMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(N21D/N45D) (SEQ ID NO: 153)
SPGQGTQSENSCTHFPGNLPDMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(N21D/E151Q) (SEQ ID NO: 154)
SPGQGTQSENSCTHFPGNLPDMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIQAYM
TMKIRN

Figure 35D

> IL-10(N21D/N45E) (SEQ ID NO: 155)
SPGQGTQSENSCTHFPGNLPDMLRDLRDAFSRVKTFFQMKDQLDELLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(Q42E/E151Q) (SEQ ID NO: 156)
SPGQGTQSENSCTHFPGNLPNMLRDLRDAFSRVKTFFQMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIQAYM
TMKIRN

> IL-10(N45D/E151Q) (SEQ ID NO: 157)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIQAYM
TMKIRN

> IL-10(N21D/Q42E/N45D) (SEQ ID NO: 158)
SPGQGTQSENSCTHFPGNLPDMLRDLRDAFSRVKTFFQMKDELDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(N21D/Q42E/E151Q) (SEQ ID NO: 159)
SPGQGTQSENSCTHFPGNLPDMLRDLRDAFSRVKTFFQMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIQAYM
TMKIRN

> IL-10(Q42E/N45D/E151Q) (SEQ ID NO: 160)
SPGQGTQSENSCTHFPGNLPNMLRDLRDAFSRVKTFFQMKDELDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIQAYM
TMKIRN

> IL-10(N21D/Q42E/N45E) (SEQ ID NO: 161)
SPGQGTQSENSCTHFPGNLPDMLRDLRDAFSRVKTFFQMKDELDELLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> IL-10(N21D/Q42E/N45D/E151Q) (SEQ ID NO: 162)
SPGQGTQSENSCTHFPGNLPDMLRDLRDAFSRVKTFFQMKDELDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIQAYM
TMKIRN

Figure 36A

> IL10M1(N21D) (SEQ ID NO: 163)
SPGQGTQSENSCTHFPGNLPDMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(D28N) (SEQ ID NO: 164)
SPGQGTQSENSCTHFPGNLPNMLRDLRNAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(Q38E) (SEQ ID NO: 165)
SPGQGTQSENSCTHFPGNLPNMLRDLRDAFSRVKTFFEMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(M39T) (SEQ ID NO: 166)
SPGQGTQSENSCTHFPGNLPNMLRDLRDAFSRVKTFFQTKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(D41N) (SEQ ID NO: 167)
SPGQGTQSENSCTHFPGNLPNMLRDLRDAFSRVKTFFQMKNQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(Q42E) (SEQ ID NO: 168)
SPGQGTQSENSCTHFPGNLPNMLRDLRDAFSRVKTFFQMKDELDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(L43V) (SEQ ID NO: 169)
SPGQGTQSENSCTHFPGNLPNMLRDLRDAFSRVKTFFQMKDQVDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(D44N) (SEQ ID NO: 170)
SPGQGTQSENSCTHFPGNLPNMLRDLRDAFSRVKTFFQMKDQLNNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(N45D) (SEQ ID NO: 171)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(I87A) (SEQ ID NO: 172)
SPGQGTQSENSCTHFPGNLPNMLRDLRDAFSRVKTFFQMKDQLDNLLLKESLLEDFKGYLGCQALSEMIQFYLEEVM
PQAENQDPDAKAHVNSLGENLKTLRLRLRRCHRFLPCENGGGSGGKSKAVEQVKNAFNKLQEKGIYKAMSEFDIFIN
YIEAYMTMKIRN

> IL10M1(E142Q) (SEQ ID NO: 173)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSQFDIFIN
YIEAYMTMKIRN

Figure 36B

> IL10M1(D144N) (SEQ ID NO: 174)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFNIFIN
YIEAYMTMKIRN

> IL10M1(E151Q) (SEQ ID NO: 175)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIQAYMTMKIRN

> IL10M1(Q38E/D41N) (SEQ ID NO: 176)
SPGQGTQSENSCTHFPGNLPNMLRDLRDAFSRVKTFFEMKNQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(Q38E/Q42E) (SEQ ID NO: 177)
SPGQGTQSENSCTHFPGNLPNMLRDLRDAFSRVKTFFEMKDELDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(Q38E/N45D) (SEQ ID NO: 178)
SPGQGTQSENSCTHFPGNLPNMLRDLRDAFSRVKTFFEMKDQLDDLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(Q38E/E142Q) (SEQ ID NO: 179)
SPGQGTQSENSCTHFPGNLPNMLRDLRDAFSRVKTFFEMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSQFDIFIN
YIEAYMTMKIRN

> IL10M1(Q38E/D144N) (SEQ ID NO: 180)
SPGQGTQSENSCTHFPGNLPNMLRDLRDAFSRVKTFFEMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFNIFIN
YIEAYMTMKIRN

> IL10M1(D41N/Q42E) (SEQ ID NO: 181)
SPGQGTQSENSCTHFPGNLPNMLRDLRDAFSRVKTFFQMKNELDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(D41N/N45D) (SEQ ID NO: 182)
SPGQGTQSENSCTHFPGNLPNMLRDLRDAFSRVKTFFQMKNQLDDLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(D41N/E142Q) (SEQ ID NO: 183)
SPGQGTQSENSCTHFPGNLPNMLRDLRDAFSRVKTFFQMKNQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSQFDIFIN
YIEAYMTMKIRN

Figure 36C

> IL10M1(D41N/D144N) (SEQ ID NO: 184)
SPGQGTQSENSCTHFPGNLPNMLRDLRDAFSRVKTFFQMKNQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFNIFIN
YIEAYMTMKIRN

> IL10M1(Q42E/N45D) (SEQ ID NO: 185)
SPGQGTQSENSCTHFPGNLPNMLRDLRDAFSRVKTFFQMKDELDDLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(Q42E/E142Q) (SEQ ID NO: 186)
SPGQGTQSENSCTHFPGNLPNMLRDLRDAFSRVKTFFQMKDELDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSQFDIFIN
YIEAYMTMKIRN

> IL10M1(Q42E/D144N) (SEQ ID NO: 187)
SPGQGTQSENSCTHFPGNLPNMLRDLRDAFSRVKTFFQMKDELDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFNIFIN
YIEAYMTMKIRN

> IL10M1(N45D/E142Q) (SEQ ID NO: 188)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSQFDIFIN
YIEAYMTMKIRN

> IL10M1(N45D/D144N) (SEQ ID NO: 189)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFNIFIN
YIEAYMTMKIRN

> IL10M1(E142Q/D144N) (SEQ ID NO: 190)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSQFNIFIN
YIEAYMTMKIRN

> IL10M1(N21D/Q42E) (SEQ ID NO: 191)
SPGQGTQSENSCTHFPGNLPDMLRDLRDAFSRVKTFFQMKDELDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(N21D/N45D) (SEQ ID NO: 192)
SPGQGTQSENSCTHFPGNLPDMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(N21D/E151Q) (SEQ ID NO: 193)
SPGQGTQSENSCTHFPGNLPDMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIQAYMTMKIRN

Figure 36D

> IL10M1(N21D/N45E) (SEQ ID NO: 194)
SPGQGTQSENSCTHFPGNLPDMLRDLRDAFSRVKTFFQMKDQLDELLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(Q42E/E151Q) (SEQ ID NO: 195)
SPGQGTQSENSCTHFPGNLPNMLRDLRDAFSRVKTFFQMKDELDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIQAYMTMKIRN

> IL10M1(N45D/E151Q) (SEQ ID NO: 196)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIQAYMTMKIRN

> IL10M1(N21D/Q42E/N45D) (SEQ ID NO: 197)
SPGQGTQSENSCTHFPGNLPDMLRDLRDAFSRVKTFFQMKDELDDLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(N21D/Q42E/E151Q) (SEQ ID NO: 198)
SPGQGTQSENSCTHFPGNLPDMLRDLRDAFSRVKTFFQMKDELDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIQAYMTMKIRN

> IL10M1(Q42E/N45D/E151Q) (SEQ ID NO: 199)
SPGQGTQSENSCTHFPGNLPNMLRDLRDAFSRVKTFFQMKDELDDLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIQAYMTMKIRN

> IL10M1(N21D/Q42E/N45E) (SEQ ID NO: 200)
SPGQGTQSENSCTHFPGNLPDMLRDLRDAFSRVKTFFQMKDELDELLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

> IL10M1(N21D/Q42E/N45D/E151Q) (SEQ ID NO: 201)
SPGQGTQSENSCTHFPGNLPDMLRDLRDAFSRVKTFFQMKDELDDLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIQAYMTMKIRN

Figure 37A

>XENP25753_empty-Fc(216)-huIL10M1.14_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 202)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.14_Fc(216)_IgG1_C220S/S364K/E357Q (SEQ ID NO: 203)
*SPGQGTQSENSCTHFPGNLPDMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK >XENP25754_empty-Fc(216)-huIL10M1.15_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 204)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.15_Fc(216)_IgG1_C220S/S364K/E357Q (SEQ ID NO: 205)
*SPGQGTQSENSCTHFPGNLPNMLRDLRNAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK >XENP25755_empty-Fc(216)-huIL10M1.16_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 206)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.16_Fc(216)_IgG1_C220S/S364K/E357Q (SEQ ID NO: 207)
*SPGQGTQSENSCTHFPGNLPNMLRDLRDAFSRVKTFFEMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 37B

>XENP25756    empty-Fc(216)-huIL10M1.17_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 208)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.17_Fc(216)_IgG1_C220S/S364K/E357Q (SEQ ID NO: 209)
*SPGQGTQSENSCTHFPGNLPNMLRDLRDAFSRVKTFFQTKDQLDNLLLKESLLEDFKGYLGCQALSEMIQFYLEEVM*
*PQAENQDPDIKAHVNSLGENLKTLRLRLRRCHRFLPCENGGSGGKSKAVEQVKNAFNKLQEKGIYKAMSEFDIFIN*
*YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

>XENP25757    empty-Fc(216)-huIL10M1.18_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 210)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.18_Fc(216)_IgG1_C220S/S364K/E357Q (SEQ ID NO: 211)
*SPGQGTQSENSCTHFPGNLPNMLRDLRDAFSRVKTFFQMKNQLDNLLLKESLLEDFKGYLGCQALSEMIQFYLEEVM*
*PQAENQDPDIKAHVNSLGENLKTLRLRLRRCHRFLPCENGGSGGKSKAVEQVKNAFNKLQEKGIYKAMSEFDIFIN*
*YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

>XENP25758    empty-Fc(216)-huIL10M1.19_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 212)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.19_Fc(216)_IgG1_C220S/S364K/E357Q (SEQ ID NO: 213)
*SPGQGTQSENSCTHFPGNLPNMLRDLRDAFSRVKTFFQMKDELDNLLLKESLLEDFKGYLGCQALSEMIQFYLEEVM*
*PQAENQDPDIKAHVNSLGENLKTLRLRLRRCHRFLPCENGGSGGKSKAVEQVKNAFNKLQEKGIYKAMSEFDIFIN*
*YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 37C

>XENP25759    empty-Fc(216)-huIL10M1.20_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 214)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.20_Fc(216)_IgG1_C220S/S364K/E357Q (SEQ ID NO: 215)
*SPGQGTQSENSCTHFPGNLPNMLRDLRDAFSRVKTFFQMKDQVDNLLLKESLLEDFKGYLGCQALSEMIQFYLEEVM*
*PQAENQDPDIKAHVNSLGENLKTLRLRLRRCHRFLPCENGGSGGKSKAVEQVKNAFNKLQEKGIYKAMSEFDIFIN*
*YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

>XENP25760    empty-Fc(216)-huIL10M1.21_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 216)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.21_Fc(216)_IgG1_C220S/S364K/E357Q (SEQ ID NO: 217)
*SPGQGTQSENSCTHFPGNLPNMLRDLRDAFSRVKTFFQMKDQLNNLLLKESLLEDFKGYLGCQALSEMIQFYLEEVM*
*PQAENQDPDIKAHVNSLGENLKTLRLRLRRCHRFLPCENGGSGGKSKAVEQVKNAFNKLQEKGIYKAMSEFDIFIN*
*YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

>XENP25761    empty-Fc(216)-huIL10M1.22_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 218)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.22_Fc(216)_IgG1_C220S/S364K/E357Q (SEQ ID NO: 219)
*SPGQGTQSENSCTHFPGNLPNMLRDLRDAFSRVKTFFQMKDQLDDLLLKESLLEDFKGYLGCQALSEMIQFYLEEVM*
*PQAENQDPDIKAHVNSLGENLKTLRLRLRRCHRFLPCENGGSGGKSKAVEQVKNAFNKLQEKGIYKAMSEFDIFIN*
*YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 37D

>XENP25763    empty-Fc(216)-huIL10M1.24_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 220)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.24_Fc(216)_IgG1_C220S/S364K/E357Q (SEQ ID NO: 221)
*SPGQGTQSENSCTHFPGNLPNMLRDLRDAFSRVKTFFQMKDQLDNLLLKESLLEDFKGYLGCQALSEMIQFYLEEVM*
*PQAENQDPDAKAHVNSLGENLKTLRLRLRRCHRFLPCENGGSGGKSKAVEQVKNAFNKLQEKGIYKAMSEFDIFIN*
*YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

>XENP25766    empty-Fc(216)-huIL10M1.27_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 222)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.27_Fc(216)_IgG1_C220S/S364K/E357Q (SEQ ID NO: 223)
*SPGQGTQSENSCTHFPGNLPNMLRDLRDAFSRVKTFFQMKDQLDNLLLKESLLEDFKGYLGCQALSEMIQFYLEEVM*
*PQAENQDPDIKAHVNSLGENLKTLRLRLRRCHRFLPCENGGSGGKSKAVEQVKNAFNKLQEKGIYKAMSQFDIFIN*
*YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

>XENP25767    empty-Fc(216)-huIL10M1.28_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 224)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.28_Fc(216)_IgG1_C220S/S364K/E357Q (SEQ ID NO: 225)
*SPGQGTQSENSCTHFPGNLPNMLRDLRDAFSRVKTFFQMKDQLDNLLLKESLLEDFKGYLGCQALSEMIQFYLEEVM*
*PQAENQDPDIKAHVNSLGENLKTLRLRLRRCHRFLPCENGGSGGKSKAVEQVKNAFNKLQEKGIYKAMSEFNIFIN*
*YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 37E

>XENP25768 empty-Fc(216)-huIL10M1.29_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 226)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.29_Fc(216)_IgG1_C220S/S364K/E357Q (SEQ ID NO: 227)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIQAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 38

| XENP | Variant | Response | $K_D$ (M) | $k_a$ (1/Ms) | $k_d$ (1/s) |
|---|---|---|---|---|---|
| 14246 | WT | 0.5241 | 5.05E-09 | 1.96E+05 | 9.90E-04 |
| 25753 | N21D | 0.5067 | 8.14E-09 | 2.10E+05 | 1.71E-03 |
| 25754 | D28N | 0.4794 | 3.86E-09 | 2.84E+05 | 1.09E-03 |
| 25755 | Q38E | 0.1064 | 6.13E-09* | 5.60E+05 | 3.43E-03 |
| 25756 | M39T | 0.4622 | 4.76E-09 | 2.59E+05 | 1.23E-03 |
| 25757 | D41N | 0.156 | 1.24E-08* | 3.43E+05 | 4.26E-03 |
| 25758 | Q42E | 0.3562 | 7.30E-09 | 1.87E+05 | 1.37E-03 |
| 25759 | L43V | 0.3277 | 1.64E-08 | 2.34E+05 | 3.83E-03 |
| 25760 | D44N | 0.3139 | 1.23E-09 | 1.61E+05 | 1.98E-04 |
| 25761 | N45D | 0.313 | 1.06E-08 | 2.52E+05 | 2.66E-03 |
| 25763 | I87A | 0.3162 | 1.44E-08 | 1.35E+05 | 1.95E-03 |
| 25766 | E142Q | 0.0007 | No Binding | - | - |
| 25767 | D144N | 0.1107 | 2.38E-08* | 5.15E+05 | 1.23E-02 |
| 25768 | E151Q | 0.2388 | 1.24E-08* | 4.46E+05 | 5.53E-03 |

Figure 39A

>huIL10.16(Q38E/Q198E) (SEQ ID NO: 228)
SPGQGTQSENSCTHFPGNLPNMLRDLRDAFSRVKTFFEMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFEMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.18(D41N/D201N) (SEQ ID NO: 229)
SPGQGTQSENSCTHFPGNLPNMLRDLRDAFSRVKTFFQMKNQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKNQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.19(Q42E/Q202E) (SEQ ID NO: 230)
SPGQGTQSENSCTHFPGNLPNMLRDLRDAFSRVKTFFQMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDELDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.22(N45D/N205D) (SEQ ID NO: 231)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.27(E142Q/E302Q) (SEQ ID NO: 232)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSQFDIFINYIEAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSQFDIFIN
YIEAYMTMKIRN

> huIL10.28(D144N/D304N) (SEQ ID NO: 233)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFNIFIN
YIEAYMTMKIRN

> huIL10.36(Q38E/D41N/Q198E/D201N) (SEQ ID NO: 234)
SPGQGTQSENSCTHFPGNLPNMLRDLRDAFSRVKTFFEMKNQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFEMKNQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

Figure 39B

> huIL10.37(Q38E/Q42E/Q198E/Q202E) (SEQ ID NO: 235)
SPGQGTQSENSCTHFPGNLPNMLRDLRDAFSRVKTFFEMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFEMKDELDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.38(Q38E/N45D/Q198E/N205D) (SEQ ID NO: 236)
SPGQGTQSENSCTHFPGNLPNMLRDLRDAFSRVKTFFEMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFEMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.39(Q38E/E142Q/Q198E/E302Q) (SEQ ID NO: 237)
SPGQGTQSENSCTHFPGNLPNMLRDLRDAFSRVKTFFEMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSQFDIFINYIEAYM
TMKIRNSPGQGTQSENSCTHFPGNLPNMLRDLRDAFSRVKTFFEMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSQFDIFIN
YIEAYMTMKIRN

> huIL10.40(Q38E/D144N/Q198E/D304N) (SEQ ID NO: 238)
SPGQGTQSENSCTHFPGNLPNMLRDLRDAFSRVKTFFEMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRNSPGQGTQSENSCTHFPGNLPNMLRDLRDAFSRVKTFFEMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFNIFIN
YIEAYMTMKIRN

> huIL10.41(D41N/Q42E/D201N/Q202E) (SEQ ID NO: 239)
SPGQGTQSENSCTHFPGNLPNMLRDLRDAFSRVKTFFQMKNELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKNELDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.42(D41N/N45D/D201N/N205D) (SEQ ID NO: 240)
SPGQGTQSENSCTHFPGNLPNMLRDLRDAFSRVKTFFQMKNQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKNQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.43(D41N/E142Q/D201N/E302Q) (SEQ ID NO: 241)
SPGQGTQSENSCTHFPGNLPNMLRDLRDAFSRVKTFFQMKNQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSQFDIFINYIEAYM
TMKIRNSPGQGTQSENSCTHFPGNLPNMLRDLRDAFSRVKTFFQMKNQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSQFDIFIN
YIEAYMTMKIRN

Figure 39C

> huIL10.44(D41N/D144N/D201N/D304N) (SEQ ID NO: 242)
SPGQGTQSENSCTHFPGNLPNMLRDLRDAFSRVKTFFQMKNQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRNSPGQGTQSENSCTHFPGNLPNMLRDLRDAFSRVKTFFQMKNQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFNIFIN
YIEAYMTMKIRN

> huIL10.45(Q42E/N45D/Q202E/N205D) (SEQ ID NO: 243)
SPGQGTQSENSCTHFPGNLPNMLRDLRDAFSRVKTFFQMKDELDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDELDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.46(Q42E/E142Q/Q202E/E302Q) (SEQ ID NO: 244)
SPGQGTQSENSCTHFPGNLPNMLRDLRDAFSRVKTFFQMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSQFDIFINYIEAYM
TMKIRNSPGQGTQSENSCTHFPGNLPNMLRDLRDAFSRVKTFFQMKDELDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSQFDIFIN
YIEAYMTMKIRN

> huIL10.47(Q42E/D144N/Q202E/D304N) (SEQ ID NO: 245)
SPGQGTQSENSCTHFPGNLPNMLRDLRDAFSRVKTFFQMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRNSPGQGTQSENSCTHFPGNLPNMLRDLRDAFSRVKTFFQMKDELDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFNIFIN
YIEAYMTMKIRN

> huIL10.48(N45D/E142Q/N205D/E302Q) (SEQ ID NO: 246)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSQFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSQFDIFIN
YIEAYMTMKIRN

> huIL10.49(N45D/D144N/N205D/D304N) (SEQ ID NO: 247)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFNIFIN
YIEAYMTMKIRN

> huIL10.50(E142Q/D144N/E302Q/D304N) (SEQ ID NO: 248)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSQFNIFINYIEAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSQFNIFIN
YIEAYMTMKIRN

Figure 39D

> huIL10.51(N21D/N181D) (SEQ ID NO: 249)
SPGQGTQSENSCTHFPGNLPDMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPDMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.52(E151Q/E311Q) (SEQ ID NO: 250)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIQAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIQAYMTMKIRN

> huIL10.53(N21D/Q42E/N181D/Q202E) (SEQ ID NO: 251)
SPGQGTQSENSCTHFPGNLPDMLRDLRDAFSRVKTFFQMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPDMLRDLRDAFSRVKTFFQMKDELDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.99(N21D/N45D/N181D/N205E) (SEQ ID NO: 252)
SPGQGTQSENSCTHFPGNLPDMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPDMLRDLRDAFSRVKTFFQMKDQLDELLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.54(N21D/N45D/N181D/N205D) (SEQ ID NO: 253)
SPGQGTQSENSCTHFPGNLPDMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPDMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.55(N21D/E151Q/N181D/E311Q) (SEQ ID NO: 254)
SPGQGTQSENSCTHFPGNLPDMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIQAYM
TMKIRNSPGQGTQSENSCTHFPGNLPDMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIQAYMTMKIRN

> huIL10.56(Q42E/E151Q/E311Q) (SEQ ID NO: 255)
SPGQGTQSENSCTHFPGNLPNMLRDLRDAFSRVKTFFQMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIQAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIQAYMTMKIRN

Figure 39E

> huIL10.57(N45D/E151Q/N205D/E311Q) (SEQ ID NO: 256)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIQAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIQAYMTMKIRN

> huIL10.58(N21D/Q42E/N45D/N181D/Q202E/N205E) (SEQ ID NO: 257)
SPGQGTQSENSCTHFPGNLPDMLRDLRDAFSRVKTFFQMKDELDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPDMLRDLRDAFSRVKTFFQMKDELDELLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.59(N21D/Q42E/E151Q/N181D/Q202E/E311Q) (SEQ ID NO: 258)
SPGQGTQSENSCTHFPGNLPDMLRDLRDAFSRVKTFFQMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIQAYM
TMKIRNSPGQGTQSENSCTHFPGNLPDMLRDLRDAFSRVKTFFQMKDELDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIQAYMTMKIRN

> huIL10.60(Q42E/N45D/E151Q/Q202E/N205D/E311Q) (SEQ ID NO: 259)
SPGQGTQSENSCTHFPGNLPNMLRDLRDAFSRVKTFFQMKDELDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIQAYM
TMKIRNSPGQGTQSENSCTHFPGNLPNMLRDLRDAFSRVKTFFQMKDELDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIQAYMTMKIRN

> huIL10.61(N21D/Q42E/N45D/E151Q/N181D/Q202E/N205D/E311Q) (SEQ ID NO: 260)
SPGQGTQSENSCTHFPGNLPDMLRDLRDAFSRVKTFFQMKDELDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIQAYM
TMKIRNSPGQGTQSENSCTHFPGNLPDMLRDLRDAFSRVKTFFQMKDELDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIQAYMTMKIRN

> huIL10.62(Q38E/N45D/N205D) (SEQ ID NO: 261)
SPGQGTQSENSCTHFPGNLPNMLRDLRDAFSRVKTFFEMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.63(D41N/N45D/N205D) (SEQ ID NO: 262)
SPGQGTQSENSCTHFPGNLPNMLRDLRDAFSRVKTFFQMKNQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

Figure 39F

> huIL10.64(N45D/D144N/N205D) (SEQ ID NO: 263)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.65(N205D) (SEQ ID NO: 264)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.66(N45D) (SEQ ID NO: 265)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.67(N21D/N45D/N205D) (SEQ ID NO: 266)
SPGQGTQSENSCTHFPGNLPDMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.68(N45D/N181D/N205D) (SEQ ID NO: 267)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPDMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.69(N45D/E151Q/N205D) (SEQ ID NO: 268)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIQAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.70(N45D/N205D/E311Q) (SEQ ID NO: 269)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIQAYMTMKIRN

Figure 39G

> huIL10.71(N45D/N205D/D304N) (SEQ ID NO: 270)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFNIFIN
YIEAYMTMKIRN

Figure 40A

>XENP25978 empty_Fc(216)-huIL10.16_huIL10.16_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S (SEQ ID NO: 271)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.16_huIL10.16_(G4S)2_IgG1_C220S/PVA_/S267K/S364K/E357Q (SEQ ID NO: 272)
*SPGQGTQSENSCTHFPGNLPNMLRDLRDAFSRVKTFFEMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFEMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP25979 empty_Fc(216)-huIL10.18_huIL10.18_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S (SEQ ID NO: 273)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.18_huIL10.18_(G4S)2_IgG1_C220S/PVA_/S267K/S364K/E357Q (SEQ ID NO: 274)
*SPGQGTQSENSCTHFPGNLPNMLRDLRDAFSRVKTFFQMKNQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKNQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP25980 empty_Fc(216)-huIL10.19_huIL10.19_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S (SEQ ID NO: 275)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Figure 40B

Chain 2 - huIL10.19_huIL10.19_(G4S)2_IgG1_C220S/PVA_/S267K/S364K/E357Q (SEQ ID NO: 276)
*SPGQGTQSENSCTHFPGNLPNMLRDLRDAFSRVKTFFQMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDELDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

**>XENP25981 empty_Fc(216)-huIL10.22_huIL10.22_(G4S)2_IgG1_pI(-
)_Isosteric_A_C220S/PVA_/S267K/L368D/K370S-IgG1_C220S/PVA_/S267K/S364K/E357Q**

Chain 1 - empty_Fc(216)_pI(-)_Isosteric_A_C220S/PVA_/S267K/L368D/K370S (SEQ ID NO: 277)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.22_huIL10.22_(G4S)2_IgG1_C220S/PVA_/S267K/S364K/E357Q (SEQ ID NO: 278)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

**>XENP25982 empty_Fc(216)-huIL10.27_huIL10.27_(G4S)2_IgG1_pI(-
)_Isosteric_A_C220S/PVA_/S267K/L368D/K370S-IgG1_C220S/PVA_/S267K/S364K/E357Q**

Chain 1 - empty_Fc(216)_pI(-)_Isosteric_A_C220S/PVA_/S267K/L368D/K370S (SEQ ID NO: 279)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.27_huIL10.27_(G4S)2_IgG1_C220S/PVA_/S267K/S364K/E357Q (SEQ ID NO: 280)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSQFDIFINYIEAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSQFDIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Figure 40C

>XENP25983 empty_Fc(216)-huIL10.28_huIL10.28_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S (SEQ ID NO: 281)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.28_huIL10.28_(G4S)2_IgG1_C220S/PVA_/S267K/S364K/E357Q (SEQ ID NO: 282)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFNIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP25984 empty_Fc(216)-huIL10.36_huIL10.36_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S (SEQ ID NO: 283)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.36_huIL10.36_(G4S)2_IgG1_C220S/PVA_/S267K/S364K/E357Q (SEQ ID NO: 284)
*SPGQGTQSENSCTHFPGNLPNMLRDLRDAFSRVKTFFEMKNQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFEMKNQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP25985 empty_Fc(216)-huIL10.37_huIL10.37_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S (SEQ ID NO: 285)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Figure 40D

Chain 2 - huIL10.37_huIL10.37_(G4S)2_IgG1_C220S/PVA_/S267K/S364K/E357Q (SEQ ID NO: 286)
*SPGQGTQSENSCTHFPGNLPNMLRDLRDAFSRVKTFFEMKDELDNLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIEAYM*
*TMKIRNSPGQGTQSENSCTHFPGNLPNMLRDLRDAFSRVKTFFEMKDELDNLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

>XENP25986 empty_Fc(216)-huIL10.38_huIL10.38_(G4S)2_IgG1_pI(-
)_Isosteric_A_C220S/PVA_/S267K/L368D/K370S-IgG1_C220S/PVA_/S267K/S364K/E357Q

Chain 1 - empty_Fc(216)_pI(-)_Isosteric_A_C220S/PVA_/S267K/L368D/K370S (SEQ ID NO: 287)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.38_huIL10.38_(G4S)2_IgG1_C220S/PVA_/S267K/S364K/E357Q (SEQ ID NO: 288)
*SPGQGTQSENSCTHFPGNLPNMLRDLRDAFSRVKTFFEMKDQLDDLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIEAYM*
*TMKIRNSPGQGTQSENSCTHFPGNLPNMLRDLRDAFSRVKTFFEMKDQLDDLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

>XENP25987 empty_Fc(216)-huIL10.39_huIL10.39_(G4S)2_IgG1_pI(-
)_Isosteric_A_C220S/PVA_/S267K/L368D/K370S-IgG1_C220S/PVA_/S267K/S364K/E357Q

Chain 1 - empty_Fc(216)_pI(-)_Isosteric_A_C220S/PVA_/S267K/L368D/K370S (SEQ ID NO: 289)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.39_huIL10.39_(G4S)2_IgG1_C220S/PVA_/S267K/S364K/E357Q (SEQ ID NO: 290)
*SPGQGTQSENSCTHFPGNLPNMLRDLRDAFSRVKTFFEMKDQLDNLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSQFDIFINYIEAYM*
*TMKIRNSPGQGTQSENSCTHFPGNLPNMLRDLRDAFSRVKTFFEMKDQLDNLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSQFDIFIN*
*YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Figure 40E

>XENP25988 empty_Fc(216)-huIL10.40_huIL10.40_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S (SEQ ID NO: 291)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.40_huIL10.40_(G4S)2_IgG1_C220S/PVA_/S267K/S364K/E357Q (SEQ ID NO: 292)
*SPGQGTQSENSCTHFPGNLPNMLRDLRDAFSRVKTFFEMKQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRNSPGQGTQSENSCTHFPGNLPNMLRDLRDAFSRVKTFFEMKQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFNIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP25989 empty_Fc(216)-huIL10.41_huIL10.41_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S (SEQ ID NO: 293)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.41_huIL10.41_(G4S)2_IgG1_C220S/PVA_/S267K/S364K/E357Q (SEQ ID NO: 294)
*SPGQGTQSENSCTHFPGNLPNMLRDLRDAFSRVKTFFQMKNELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKNELDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP25990 empty_Fc(216)-huIL10.42_huIL10.42_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S (SEQ ID NO: 295)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Figure 40F

Chain 2 - huIL10.42_huIL10.42_(G4S)2_IgG1_C220S/PVA_/S267K/S364K/E357Q (SEQ ID NO: 296)
*SPGQGTQSENSCTHFPGNLPNMLRDLRDAFSRVKTFFQMKNQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKNQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

>XENP25991 empty_Fc(216)-huIL10.43_huIL10.43_(G4S)2_IgG1_pI(-)_Isosteric_A_C220S/PVA_/S267K/L368D/K370S-IgG1_C220S/PVA_/S267K/S364K/E357Q

Chain 1 - empty_Fc(216)_pI(-)_Isosteric_A_C220S/PVA_/S267K/L368D/K370S (SEQ ID NO: 297)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.43_huIL10.43_(G4S)2_IgG1_C220S/PVA_/S267K/S364K/E357Q (SEQ ID NO: 298)
*SPGQGTQSENSCTHFPGNLPNMLRDLRDAFSRVKTFFQMKNQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSQFDIFINYIEAYM
TMKIRNSPGQGTQSENSCTHFPGNLPNMLRDLRDAFSRVKTFFQMKNQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSQFDIFIN
YIEAYMTMKIRN\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

>XENP25992 empty_Fc(216)-huIL10.44_huIL10.44_(G4S)2_IgG1_pI(-)_Isosteric_A_C220S/PVA_/S267K/L368D/K370S-IgG1_C220S/PVA_/S267K/S364K/E357Q

Chain 1 - empty_Fc(216)_pI(-)_Isosteric_A_C220S/PVA_/S267K/L368D/K370S (SEQ ID NO: 299)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.44_huIL10.44_(G4S)2_IgG1_C220S/PVA_/S267K/S364K/E357Q (SEQ ID NO: 300)
*SPGQGTQSENSCTHFPGNLPNMLRDLRDAFSRVKTFFQMKNQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRNSPGQGTQSENSCTHFPGNLPNMLRDLRDAFSRVKTFFQMKNQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFNIFIN
YIEAYMTMKIRN\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

Figure 40G

>XENP25993 empty_Fc(216)-huIL10.45_huIL10.45_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S (SEQ ID NO: 301)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.45_huIL10.45_(G4S)2_C220S/PVA_/S267K/S364K/E357Q (SEQ ID NO: 302)
*SPGQGTQSENSCTHFPGNLPNMLRDLRDAFSRVKTFFQMKDELDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDELDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

>XENP25994 empty_Fc(216)-huIL10.46_huIL10.46_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S (SEQ ID NO: 303)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.46_huIL10.46_(G4S)2_IgG1_C220S/PVA_/S267K/S364K/E357Q (SEQ ID NO: 304)
*SPGQGTQSENSCTHFPGNLPNMLRDLRDAFSRVKTFFQMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSQFDIFINYIEAYM
TMKIRNSPGQGTQSENSCTHFPGNLPNMLRDLRDAFSRVKTFFQMKDELDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSQFDIFIN
YIEAYMTMKIRN\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

>XENP25995 empty_Fc(216)-huIL10.47_huIL10.47_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S (SEQ ID NO: 305)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Figure 40H

Chain 2 - huIL10.47_huIL10.47_(G4S)2_IgG1_C220S/PVA_/S267K/S364K/E357Q (SEQ ID NO: 306)
*SPGQGTQSENSCTHFPGNLPNMLRDLRDAFSRVKTFFQMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRNSPGQGTQSENSCTHFPGNLPNMLRDLRDAFSRVKTFFQMKDELDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFNIFIN
YIEAYMTMKIRN\*GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

**>XENP25996 empty_Fc(216)-huIL10.48_huIL10.48_(G4S)2_IgG1_pI(-
)_Isosteric_A_C220S/PVA_/S267K/L368D/K370S-IgG1_C220S/PVA_/S267K/S364K/E357Q**

Chain 1 - empty_Fc(216)_pI(-)_Isosteric_A_C220S/PVA_/S267K/L368D/K370S (SEQ ID NO: 307)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.48_huIL10.48_(G4S)2_IgG1_C220S/PVA_/S267K/S364K/E357Q (SEQ ID NO: 308)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSQFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSQFDIFIN
YIEAYMTMKIRN\*GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

**>XENP26001 empty_Fc(216)-huIL10.49_huIL10.49_(G4S)2_IgG1_pI(-
)_Isosteric_A_C220S/PVA_/S267K/L368D/K370S-IgG1_C220S/PVA_/S267K/S364K/E357Q**

Chain 1 - empty_Fc(216)_pI(-)_Isosteric_A_C220S/PVA_/S267K/L368D/K370S (SEQ ID NO: 309)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.49_huIL10.49_(G4S)2_IgG1_C220S/PVA_/S267K/S364K/E357Q (SEQ ID NO: 310)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFNIFIN
YIEAYMTMKIRN\*GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Figure 40I

>XENP26002 empty_Fc(216)-huIL10.50_huIL10.50_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S (SEQ ID NO: 311)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.50_huIL10.50_(G4S)2_IgG1_C220S/PVA_/S267K/S364K/E357Q (SEQ ID NO: 312)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSQFNIFINYIEAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSQFNIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP27220 empty-huIL10.51_huIL10.51_(G4S)2-Fc(216)_IgG1_pI(-)_Isosteric_A_PVA_/S267K/L368D/K370S-
Fc(216)_IgG1_C220S/PVA_/S267K/S364K/E357Q Chain 1 - empty_Fc(216)_pI(-)_Isosteric_A_C220S/PVA_/S267K/L368D/K370S (SEQ ID NO: 313)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.51_huIL10.51_(G4S)2-Fc(216)_IgG1_C220S/PVA_/S267K/S364K/E357Q (SEQ ID NO: 314)
*SPGQGTQSENSCTHFPGNLPDMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPDMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP27221 empty-huIL10.53_huIL10.53_(G4S)2-Fc(216)_IgG1_pI(-)_Isosteric_A_PVA_/S267K/L368D/K370S-
Fc(216)_IgG1_C220S/PVA_/S267K/S364K/E357Q Chain 1 - empty_Fc(216)_pI(-)_Isosteric_A_C220S/PVA_/S267K/L368D/K370S (SEQ ID NO: 315)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Figure 40J

Chain 2 - huIL10.53_huIL10.53_(G4S)2_Fc(216)_IgG1_C220S/PVA_/S267K/S364K/E357Q (SEQ ID NO: 316)

*SPGQGTQSENSCTHFPGNLPDMLRDLRDAFSRVKTFFQMKDELDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPDMLRDLRDAFSRVKTFFQMKDELDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

>XENP27222 empty-huIL10.99_huIL10.99_(G4S)2-Fc(216)_IgG1_pI(-)_Isosteric_A_PVA_/S267K/L368D/K370S-Fc(216)_IgG1_C220S/PVA_/S267K/S364K/E357Q

Chain 1 - empty_Fc(216)_pI(-)_Isosteric_A_C220S/PVA_/S267K/L368D/K370S (SEQ ID NO: 317)

EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.99_huIL10.99_(G4S)2_Fc(216)_IgG1_C220S/PVA_/S267K/S364K/E357Q (SEQ ID NO: 318)

*SPGQGTQSENSCTHFPGNLPDMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPDMLRDLRDAFSRVKTFFQMKDQLDELLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

>XENP27223 empty-huIL10.57_huIL10.57_(G4S)2-Fc(216)_IgG1_pI(-)_Isosteric_A_PVA_/S267K/L368D/K370S-Fc(216)_IgG1_C220S/PVA_/S267K/S364K/E357Q

Chain 1 - empty_Fc(216)_pI(-)_Isosteric_A_C220S/PVA_/S267K/L368D/K370S (SEQ ID NO: 319)

EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.57_huIL10.57_(G4S)2_Fc(216)_IgG1_C220S/PVA_/S267K/S364K/E357Q (SEQ ID NO: 320)

*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIQAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIQAYMTMKIRN\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

Figure 40K

>XENP27224 empty-huIL10.58_huIL10.58_(G4S)2-Fc(216)_IgG1_pI(-)_Isosteric_A_PVA_/S267K/L368D/K370S-Fc(216)_IgG1_C220S/PVA_/S267K/S364K/E357Q Chain 1 - empty_Fc(216)_pI(-)_Isosteric_A_C220S/PVA_/S267K/L368D/K370S (SEQ ID NO: 321)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.58_huIL10.58_(G4S)2_Fc(216)_IgG1_C220S/PVA_/S267K/S364K/E357Q (SEQ ID NO: 322)
*SPGQGTQSENSCTHFPGNLPDMLRDLRDAFSRVKTFFQMKDELDDLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIEAYM*
*TMKIRNSPGQGTQSENSCTHFPGNLPDMLRDLRDAFSRVKTFFQMKDELDELLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP27225 empty-huIL10.60_huIL10.60_(G4S)2-Fc(216)_IgG1_pI(-)_Isosteric_A_PVA_/S267K/L368D/K370S-Fc(216)_IgG1_C220S/PVA_/S267K/S364K/E357Q Chain 1 - empty_Fc(216)_pI(-)_Isosteric_A_C220S/PVA_/S267K/L368D/K370S (SEQ ID NO: 323)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.60_huIL10.60_(G4S)2_Fc(216)_IgG1_C220S/PVA_/S267K/S364K/E357Q (SEQ ID NO: 324)
*SPGQGTQSENSCTHFPGNLPNMLRDLRDAFSRVKTFFQMKDELDDLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIQAYM*
*TMKIRNSPGQGTQSENSCTHFPGNLPNMLRDLRDAFSRVKTFFQMKDELDDLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIQAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP27226 empty-huIL10.64_huIL10.64_(G4S)2-Fc(216)_IgG1_pI(-)_Isosteric_A_PVA_/S267K/L368D/K370S-Fc(216)_IgG1_C220S/PVA_/S267K/S364K/E357Q Chain 1 - empty_Fc(216)_pI(-)_Isosteric_A_C220S/PVA_/S267K/L368D/K370S (SEQ ID NO: 325)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Figure 40L

Chain 2 - huIL10.64_huIL10.64_(G4S)2_Fc(216)_IgG1_C220S/PVA_/S267K/S364K/E357Q (SEQ ID NO: 326)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN\*GGGGSGGGGS\*EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

>XENP27987 empty-huIL10.65_huIL10.65_(G4S)2-Fc(216)_IgG1_pI(-)_Isosteric_A_PVA_/S267K/L368D/K370S-Fc(216)_IgG1_C220S/PVA_/S267K/S364K/E357Q

Chain 1 - empty_Fc(216)_pI(-)_Isosteric_A_C220S/PVA_/S267K/L368D/K370S (SEQ ID NO: 327)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.65_huIL10.65_(G4S)2-Fc(216)_IgG1_C220S/PVA_/S267K/S364K/E357Q (SEQ ID NO: 328)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN\*GGGGSGGGGS\*EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

>XENP27988 empty-huIL10.66_huIL10.66_(G4S)2-Fc(216)_IgG1_pI(-)_Isosteric_A_PVA_/S267K/L368D/K370S-Fc(216)_IgG1_C220S/PVA_/S267K/S364K/E357Q

Chain 1 - empty_Fc(216)_pI(-)_Isosteric_A_C220S/PVA_/S267K/L368D/K370S (SEQ ID NO: 329)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.66_huIL10.66_(G4S)2_Fc(216)_IgG1_C220S/PVA_/S267K/S364K/E357Q (SEQ ID NO: 330)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN\*GGGGSGGGGS\*EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

Figure 40M

>XENP27989 empty-huIL10.67_huIL10.67_(G4S)2-Fc(216)_IgG1_pI(-)_Isosteric_A_PVA_/S267K/L368D/K370S-Fc(216)_IgG1_C220S/PVA_/S267K/S364K/E357Q Chain 1 - empty_Fc(216)_pI(-)_Isosteric_A_C220S/PVA_/S267K/L368D/K370S (SEQ ID NO: 331)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.67_huIL10.67_(G4S)2_Fc(216)_IgG1_C220S/PVA_/S267K/S364K/E357Q (SEQ ID NO: 332)
*SPGQGTQSENSCTHFPGNLPDMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP27990 empty-huIL10.68_huIL10.68_(G4S)2-Fc(216)_IgG1_pI(-)_Isosteric_A_PVA_/S267K/L368D/K370S-Fc(216)_IgG1_C220S/PVA_/S267K/S364K/E357Q Chain 1 - empty_Fc(216)_pI(-)_Isosteric_A_C220S/PVA_/S267K/L368D/K370S (SEQ ID NO: 333)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.68_huIL10.68_(G4S)2_Fc(216)_IgG1_C220S/PVA_/S267K/S364K/E357Q (SEQ ID NO: 334)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPDMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP27991 empty-huIL10.69_huIL10.69_(G4S)2-Fc(216)_IgG1_pI(-)_Isosteric_A_PVA_/S267K/L368D/K370S-Fc(216)_IgG1_C220S/PVA_/S267K/S364K/E357Q Chain 1 - empty_Fc(216)_pI(-)_Isosteric_A_C220S/PVA_/S267K/L368D/K370S (SEQ ID NO: 335)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Figure 40N

Chain 2 - huIL10.69_huIL10.69_(G4S)2_Fc(216)_IgG1_C220S/PVA_/S267K/S364K/E357Q (SEQ ID NO: 336)
*SPGQGTQSENSCTHFPGNLPNMLRDLRDAFSRVKTFFQMKDQLDDLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIQAYM*
*TMKIRNSPGQGTQSENSCTHFPGNLPNMLRDLRDAFSRVKTFFQMKDQLDDLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

>XENP27992 empty-huIL10.70_huIL10.70_(G4S)2-Fc(216)_IgG1_pI(-)_Isosteric_A_PVA_/S267K/L368D/K370S-Fc(216)_IgG1_C220S/PVA_/S267K/S364K/E357Q

Chain 1 - empty_Fc(216)_pI(-)_Isosteric_A_C220S/PVA_/S267K/L368D/K370S (SEQ ID NO: 337)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.70_huIL10.70_(G4S)2_Fc(216)_IgG1_C220S/PVA_/S267K/S364K/E357Q (SEQ ID NO: 338)
*SPGQGTQSENSCTHFPGNLPNMLRDLRDAFSRVKTFFQMKDQLDDLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIEAYM*
*TMKIRNSPGQGTQSENSCTHFPGNLPNMLRDLRDAFSRVKTFFQMKDQLDDLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIQAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

>XENP27993 empty-huIL10.71_huIL10.71_(G4S)2-Fc(216)_IgG1_pI(-)_Isosteric_A_PVA_/S267K/L368D/K370S-Fc(216)_IgG1_C220S/PVA_/S267K/S364K/E357Q

Chain 1 - empty_Fc(216)_pI(-)_Isosteric_A_C220S/PVA_/S267K/L368D/K370S (SEQ ID NO: 339)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.71_huIL10.71_(G4S)2_Fc(216)_IgG1_C220S/PVA_/S267K/S364K/E357Q (SEQ ID NO: 340)
*SPGQGTQSENSCTHFPGNLPNMLRDLRDAFSRVKTFFQMKDQLDDLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIEAYM*
*TMKIRNSPGQGTQSENSCTHFPGNLPNMLRDLRDAFSRVKTFFQMKDQLDDLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFNIFIN*
*YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Figure 41A

>XENP28741 empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10.22_huIL10.22

Chain 1 - empty_Fc(216)_pI(-)_Isosteric_A_C220S/PVA_/S267K/L368D/K370S (SEQ ID NO: 341)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - Fc(216)_IgG1_C220S/PVA_/S267K/S364K/E357Q/K447del_(G4S)3_huIL10.22_huIL10.22 (SEQ ID NO: 342)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG\
GGGGSGGGGSGGGGS\SPGQGTQSENSCTHFPGNLPNMLRDLRDAFSRVKTFFQMKDQLDDLLLKESLLEDFKGYLG
CQALSEMIQFYLEEVMPQAENQDPDIKAHVNSLGENLKTLRLRLRRCLRFLPCENKSKAVEQVKNAFNKLQEKGIYK
AMSEFDIFINYIEAYMTMKIRNSPGQGTQSENSCTHFPGNLPNMLRDLRDAFSRVKTFFQMKDQLDDLLLKESLLED
FKGYLGCQALSEMIQFYLEEVMPQAENQDPDIKAHVNSLGENLKTLRLRLRRCLRFLPCENKSKAVEQVKNAFNKLQ
EKGIYKAMSEFDIFINYIEAYMTMKIRN >XENP28742 empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10.45_huIL10.45

Chain 1 - empty_Fc(216)_pI(-)_Isosteric_A_C220S/PVA_/S267K/L368D/K370S (SEQ ID NO: 343)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - Fc(216)_IgG1_C220S/PVA_/S267K/S364K/E357Q/K447del_(G4S)3_huIL10.45_huIL10.45 (SEQ ID NO: 344)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG\
GGGGSGGGGSGGGGS\SPGQGTQSENSCTHFPGNLPNMLRDLRDAFSRVKTFFQMKDELDDLLLKESLLEDFKGYLG
CQALSEMIQFYLEEVMPQAENQDPDIKAHVNSLGENLKTLRLRLRRCLRFLPCENKSKAVEQVKNAFNKLQEKGIYK
AMSEFDIFINYIEAYMTMKIRNSPGQGTQSENSCTHFPGNLPNMLRDLRDAFSRVKTFFQMKDELDDLLLKESLLED
FKGYLGCQALSEMIQFYLEEVMPQAENQDPDIKAHVNSLGENLKTLRLRLRRCLRFLPCENKSKAVEQVKNAFNKLQ
EKGIYKAMSEFDIFINYIEAYMTMKIRN

Figure 41B

>XENP28743 empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10.51_huIL10.51

Chain 1 - empty_Fc(216)_pI(-)_Isosteric_A_C220S/PVA_/S267K/L368D/K370S (SEQ ID NO: 345)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - Fc(216)_IgG1_C220S/PVA_/S267K/S364K/E357Q/K447del_(G4S)3_huIL10.51_huIL10.51 (SEQ ID NO: 346)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG\
GGGGSGGGGSGGGGS\SPGQGTQSENSCTHFPGNLPDMLRDLRDAFSRVKTFFQMKDQLDNLLLKESLLEDFKGYLG
CQALSEMIQFYLEEVMPQAENQDPDIKAHVNSLGENLKTLRLRLRRCLRFLPCENKSKAVEQVKNAFNKLQEKGIYK
AMSEFDIFINYIEAYMTMKIRNSPGQGTQSENSCTHFPGNLPDMLRDLRDAFSRVKTFFQMKDQLDNLLLKESLLED
FKGYLGCQALSEMIQFYLEEVMPQAENQDPDIKAHVNSLGENLKTLRLRLRRCLRFLPCENKSKAVEQVKNAFNKLQ
EKGIYKAMSEFDIFINYIEAYMTMKIRN >XENP28744 empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10.64_huIL10.64

Chain 1 - empty_Fc(216)_pI(-)_Isosteric_A_C220S/PVA_/S267K/L368D/K370S (SEQ ID NO: 347)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - Fc(216)_IgG1_C220S/PVA_/S267K/S364K/E357Q/K447del_(G4S)3_huIL10.64_huIL10.64 (SEQ ID NO: 348)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG\
GGGGSGGGGSGGGGS\SPGQGTQSENSCTHFPGNLPNMLRDLRDAFSRVKTFFQMKDQLDDLLLKESLLEDFKGYLG
CQALSEMIQFYLEEVMPQAENQDPDIKAHVNSLGENLKTLRLRLRRCLRFLPCENKSKAVEQVKNAFNKLQEKGIYK
AMSEFNIFINYIEAYMTMKIRNSPGQGTQSENSCTHFPGNLPNMLRDLRDAFSRVKTFFQMKDQLDDLLLKESLLED
FKGYLGCQALSEMIQFYLEEVMPQAENQDPDIKAHVNSLGENLKTLRLRLRRCLRFLPCENKSKAVEQVKNAFNKLQ
EKGIYKAMSEFDIFINYIEAYMTMKIRN

Figure 41C

>XENP28745 empty_Fc-IgG1_pI(-)_Isosteric_A_PVA_/S267K/L368D/K370S-Fc(216)_IgG1_C220S/PVA_/S267K/S364K/E357Q/K447del_(G4S)3_huIL10.67_huIL10.67

Chain 1 - empty_Fc(216)_pI(-)_Isosteric_A_C220S/PVA_/S267K/L368D/K370S (SEQ ID NO: 349)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - Fc(216)_IgG1_C220S/PVA_/S267K/S364K/E357Q/K447del_(G4S)3_huIL10.67_huIL10.67 (SEQ ID NO: 350)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG\
GGGGSGGGGSGGGGS\SPGQGTQSENSCTHFPGNLPDMLRDLRDAFSRVKTFFQMKDQLDDLLLKESLLEDFKGYLG
CQALSEMIQFYLEEVMPQAENQDPDIKAHVNSLGENLKTLRLRLRRCLRFLPCENKSKAVEQVKNAFNKLQEKGIYK
AMSEFDIFINYIEAYMTMKIRNSPGQGTQSENSCTHFPGNLPDMLRDLRDAFSRVKTFFQMKDQLDDLLLKESLLED
FKGYLGCQALSEMIQFYLEEVMPQAENQDPDIKAHVNSLGENLKTLRLRLRRCLRFLPCENKSKAVEQVKNAFNKLQ
EKGIYKAMSEFDIFINYIEAYMTMKIRN

>XENP28746 empty_Fc-IgG1_pI(-)_Isosteric_A_PVA_/S267K/L368D/K370S-Fc(216)_IgG1_C220S/PVA_/S267K/S364K/E357Q/K447del_(G4S)3_huIL10.68_huIL10.68

Chain 1 - empty_Fc(216)_pI(-)_Isosteric_A_C220S/PVA_/S267K/L368D/K370S (SEQ ID NO: 351)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - Fc(216)_IgG1_C220S/PVA_/S267K/S364K/E357Q/K447del_(G4S)3_huIL10.68_huIL10.68 (SEQ ID NO: 352)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG\
GGGGSGGGGSGGGGS\SPGQGTQSENSCTHFPGNLPNMLRDLRDAFSRVKTFFQMKDQLDDLLLKESLLEDFKGYLG
CQALSEMIQFYLEEVMPQAENQDPDIKAHVNSLGENLKTLRLRLRRCLRFLPCENKSKAVEQVKNAFNKLQEKGIYK
AMSEFDIFINYIEAYMTMKIRNSPGQGTQSENSCTHFPGNLPDMLRDLRDAFSRVKTFFQMKDQLDDLLLKESLLED
FKGYLGCQALSEMIQFYLEEVMPQAENQDPDIKAHVNSLGENLKTLRLRLRRCLRFLPCENKSKAVEQVKNAFNKLQ
EKGIYKAMSEFDIFINYIEAYMTMKIRN

Figure 41D

>XENP28747_empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10.69_huIL10.69

Chain 1 - empty_Fc(216)_pI(-)_Isosteric_A_C220S/PVA_/S267K/L368D/K370S (SEQ ID NO: 353)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - Fc(216)_IgG1_C220S/PVA_/S267K/S364K/E357Q/K447del_(G4S)3_huIL10.69_huIL10.69 (SEQ ID NO: 354)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG\
<u>GGGGSGGGGSGGGGS</u>\SPGQGTQSENSCTHFPGNLPNMLRDLRDAFSRVKTFFQMKDQLDDLLLKESLLEDFKGYLG
CQALSEMIQFYLEEVMPQAENQDPDIKAHVNSLGENLKTLRLRLRRCLRFLPCENKSKAVEQVKNAFNKLQEKGIYK
AMSEFDIFINYIQAYMTMKIRNSPGQGTQSENSCTHFPGNLPNMLRDLRDAFSRVKTFFQMKDQLDDLLLKESLLED
FKGYLGCQALSEMIQFYLEEVMPQAENQDPDIKAHVNSLGENLKTLRLRLRRCLRFLPCENKSKAVEQVKNAFNKLQ
EKGIYKAMSEFDIFINYIEAYMTMKIRN >XENP28748_empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10.71_huIL10.71

Chain 1 - empty_Fc(216)_pI(-)_Isosteric_A_C220S/PVA_/S267K/L368D/K370S (SEQ ID NO: 355)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - Fc(216)_IgG1_C220S/PVA_/S267K/S364K/E357Q/K447del_(G4S)3_huIL10.71_huIL10.71 (SEQ ID NO: 356)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG\
<u>GGGGSGGGGSGGGGS</u>\SPGQGTQSENSCTHFPGNLPNMLRDLRDAFSRVKTFFQMKDQLDDLLLKESLLEDFKGYLG
CQALSEMIQFYLEEVMPQAENQDPDIKAHVNSLGENLKTLRLRLRRCLRFLPCENKSKAVEQVKNAFNKLQEKGIYK
AMSEFDIFINYIEAYMTMKIRNSPGQGTQSENSCTHFPGNLPNMLRDLRDAFSRVKTFFQMKDQLDDLLLKESLLED
FKGYLGCQALSEMIQFYLEEVMPQAENQDPDIKAHVNSLGENLKTLRLRLRRCLRFLPCENKSKAVEQVKNAFNKLQ
EKGIYKAMSEFNIFINYIEAYMTMKIRN

Figure 41E

>XENP28749 empty_Fc-IgG1_pI(-)_Isosteric_A_PVA_/S267K/L368D/K370S-Fc(216)_IgG1_C220S/PVA_/S267K/S364K/E357Q/K447del_(G4S)3_huIL10.38_huIL10.38

Chain 1 - empty_Fc(216)_pI(-)_Isosteric_A_C220S/PVA_/S267K/L368D/K370S (SEQ ID NO: 357)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - Fc(216)_IgG1_C220S/PVA_/S267K/S364K/E357Q/K447del_(G4S)3_huIL10.38_huIL10.38 (SEQ ID NO: 358)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG\
GGGGSGGGGSGGGGS\SPGQGTQSENSCTHFPGNLPNMLRDLRDAFSRVKTFFEMKDQLDDLLLKESLLEDFKGYLG
CQALSEMIQFYLEEVMPQAENQDPDIKAHVNSLGENLKTLRLRLRRCLRFLPCENKSKAVEQVKNAFNKLQEKGIYK
AMSEFDIFINYIEAYMTMKIRNSPGQGTQSENSCTHFPGNLPNMLRDLRDAFSRVKTFFEMKDQLDDLLLKESLLED
FKGYLGCQALSEMIQFYLEEVMPQAENQDPDIKAHVNSLGENLKTLRLRLRRCLRFLPCENKSKAVEQVKNAFNKLQ
EKGIYKAMSEFDIFINYIEAYMTMKIRN

>XENP28750 empty_Fc-IgG1_pI(-)_Isosteric_A_PVA_/S267K/L368D/K370S-Fc(216)_IgG1_C220S/PVA_/S267K/S364K/E357Q/K447del_(G4S)3_huIL10.54_huIL10.54

Chain 1 - empty_Fc(216)_pI(-)_Isosteric_A_C220S/PVA_/S267K/L368D/K370S (SEQ ID NO: 359)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - Fc(216)_IgG1_C220S/PVA_/S267K/S364K/E357Q/K447del_(G4S)3_huIL10.54_huIL10.54 (SEQ ID NO: 360)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG\
GGGGSGGGGSGGGGS\SPGQGTQSENSCTHFPGNLPDMLRDLRDAFSRVKTFFQMKDQLDDLLLKESLLEDFKGYLG
CQALSEMIQFYLEEVMPQAENQDPDIKAHVNSLGENLKTLRLRLRRCLRFLPCENKSKAVEQVKNAFNKLQEKGIYK
AMSEFDIFINYIEAYMTMKIRNSPGQGTQSENSCTHFPGNLPDMLRDLRDAFSRVKTFFQMKDQLDDLLLKESLLED
FKGYLGCQALSEMIQFYLEEVMPQAENQDPDIKAHVNSLGENLKTLRLRLRRCLRFLPCENKSKAVEQVKNAFNKLQ
EKGIYKAMSEFDIFINYIEAYMTMKIRN

Figure 41F

>XENP28751 empty_Fc-IgG1_pI(-)_Isosteric_A_PVA_/S267K/L368D/K370S-Fc(216)_IgG1_C220S/PVA_/S267K/S364K/E357Q/K447del_(G4S)3_huIL10.57_huIL10.57

Chain 1 - empty_Fc(216)_pI(-)_Isosteric_A_C220S/PVA_/S267K/L368D/K370S (SEQ ID NO: 361)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - Fc(216)_IgG1_C220S/PVA_/S267K/S364K/E357Q/K447del_(G4S)3_huIL10.57_huIL10.57 (SEQ ID NO: 362)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG\
GGGGSGGGGSGGGGS\SPGQGTQSENSCTHFPGNLPNMLRDLRDAFSRVKTFFQMKDQLDDLLLKESLLEDFKGYLG
CQALSEMIQFYLEEVMPQAENQDPDIKAHVNSLGENLKTLRLRLRRCLRFLPCENKSKAVEQVKNAFNKLQEKGIYK
AMSEFDIFINYIQAYMTMKIRNSPGQGTQSENSCTHFPGNLPNMLRDLRDAFSRVKTFFQMKDQLDDLLLKESLLED
FKGYLGCQALSEMIQFYLEEVMPQAENQDPDIKAHVNSLGENLKTLRLRLRRCLRFLPCENKSKAVEQVKNAFNKLQ
EKGIYKAMSEFDIFINYIQAYMTMKIRN

>XENP28752 empty_Fc-IgG1_pI(-)_Isosteric_A_PVA_/S267K/L368D/K370S-Fc(216)_IgG1_C220S/PVA_/S267K/S364K/E357Q/K447del_(G4S)3_huIL10.62_huIL10.62

Chain 1 - empty_Fc(216)_pI(-)_Isosteric_A_C220S/PVA_/S267K/L368D/K370S (SEQ ID NO: 363)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - Fc(216)_IgG1_C220S/PVA_/S267K/S364K/E357Q/K447del_(G4S)3_huIL10.62_huIL10.62 (SEQ ID NO: 364)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG\
GGGGSGGGGSGGGGS\SPGQGTQSENSCTHFPGNLPNMLRDLRDAFSRVKTFFEMKDQLDDLLLKESLLEDFKGYLG
CQALSEMIQFYLEEVMPQAENQDPDIKAHVNSLGENLKTLRLRLRRCLRFLPCENKSKAVEQVKNAFNKLQEKGIYK
AMSEFDIFINYIEAYMTMKIRNSPGQGTQSENSCTHFPGNLPNMLRDLRDAFSRVKTFFQMKDQLDDLLLKESLLED
FKGYLGCQALSEMIQFYLEEVMPQAENQDPDIKAHVNSLGENLKTLRLRLRRCLRFLPCENKSKAVEQVKNAFNKLQ
EKGIYKAMSEFDIFINYIEAYMTMKIRN

Figure 41G

>XENP28753 empty_Fc-IgG1_pI(-)_Isosteric_A_PVA_/S267K/L368D/K370S-Fc(216)_IgG1_C220S/PVA_/S267K/S364K/E357Q/K447del_(G4S)3_huIL10.63_huIL10.63

Chain 1 - empty_Fc(216)_pI(-)_Isosteric_A_C220S/PVA_/S267K/L368D/K370S (SEQ ID NO: 365)

EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - Fc(216)_IgG1_C220S/PVA_/S267K/S364K/E357Q/K447del_(G4S)3_huIL10.63_huIL10.63 (SEQ ID NO: 366)

EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG\
GGGGSGGGGSGGGGS\SPGQGTQSENSCTHFPGNLPNMLRDLRDAFSRVKTFFQMKNQLDDLLLKESLLEDFKGYLG
CQALSEMIQFYLEEVMPQAENQDPDIKAHVNSLGENLKTLRLRLRRCLRFLPCENKSKAVEQVKNAFNKLQEKGIYK
AMSEFDIFINYIEAYMTMKIRNSPGQGTQSENSCTHFPGNLPNMLRDLRDAFSRVKTFFQMKDQLDDLLLKESLLED
FKGYLGCQALSEMIQFYLEEVMPQAENQDPDIKAHVNSLGENLKTLRLRLRRCLRFLPCENKSKAVEQVKNAFNKLQ
EKGIYKAMSEFDIFINYIEAYMTMKIRN

Figure 46A-Figure 46C
Fig. 46A)
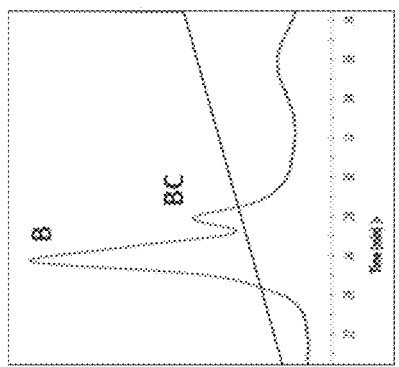
Purification of eluate from Protein A Chromatography via Cation Exchange Chromatography
Fig. 46B)
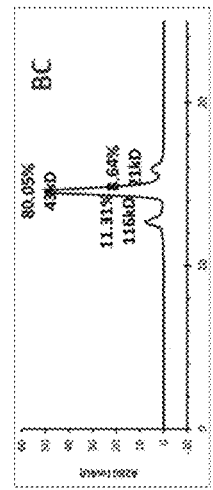
aSEC-MALS
Fig. 46C)
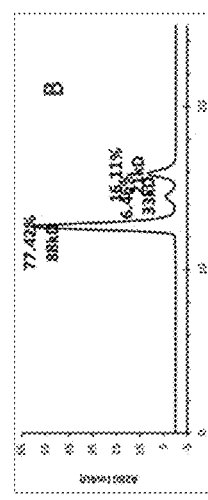
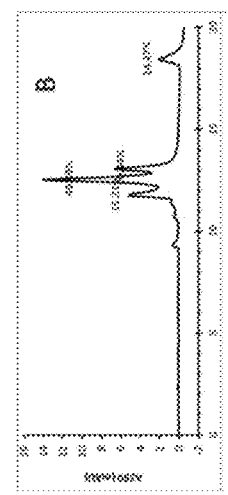
aCIEX Figure 47A-Figure 47E
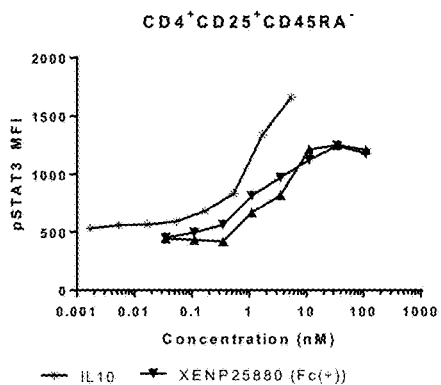
Fig. 47A)
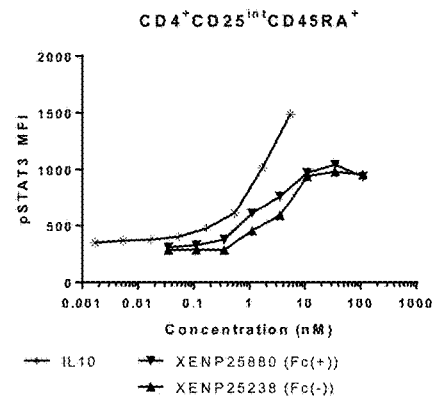
Fig. 47B)
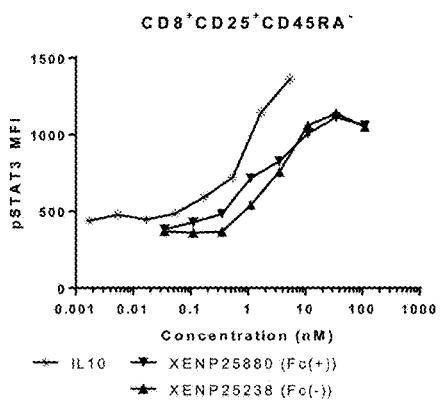
Fig. 47C)
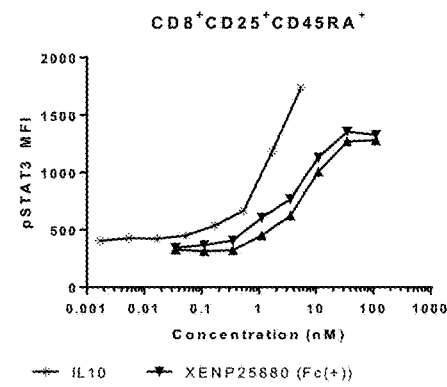
Fig. 47D)
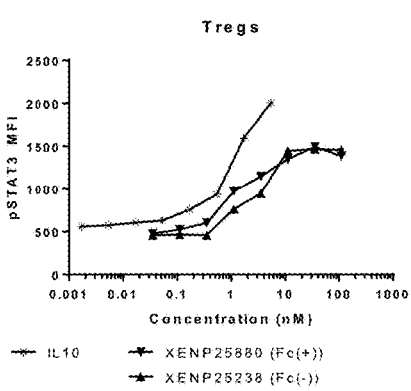
Fig. 47E)

Figure 48

> scIL-10(G₄S) (SEQ ID NO: 367)

SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN/GGGGS/SPGQGTQSENSCTHFPGNLPNMLRDLRDAFSRVKTFFQMKDQLDNLLLKESLLEDFKGYLGCQA
LSEMIQFYLEEVMPQAENQDPDIKAHVNSLGENLKTLRLRLRRCLRFLPCENKSKAVEQVKNAFNKLQEKGIYKAMS
EFDIFINYIEAYMTMKIRN

> scIL-10((G₄S)₂) (SEQ ID NO: 368)

SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN/GGGGSGGGGS/SPGQGTQSENSCTHFPGNLPNMLRDLRDAFSRVKTFFQMKDQLDNLLLKESLLEDFKGY
LGCQALSEMIQFYLEEVMPQAENQDPDIKAHVNSLGENLKTLRLRLRRCLRFLPCENKSKAVEQVKNAFNKLQEKGI
YKAMSEFDIFINYIEAYMTMKIRN

> scIL-10((G₄S)₃) (SEQ ID NO: 369)

SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN/GGGGSGGGGSGGGGS/SPGQGTQSENSCTHFPGNLPNMLRDLRDAFSRVKTFFQMKDQLDNLLLKESLLE
DFKGYLGCQALSEMIQFYLEEVMPQAENQDPDIKAHVNSLGENLKTLRLRLRRCLRFLPCENKSKAVEQVKNAFNKL
QEKGIYKAMSEFDIFINYIEAYMTMKIRN

Figure 49A

>XENP25239 huIL10_(G4S)_huIL10_(G4S)2-empty_Fc(216)_IgG1_pI(-
)_Isosteric_A_C220S/PVA_/S267K/L368D/K370S-IgG1_C220S/PVA_/S267K/S364K/E357Q XENP25239 Chain 1 - huIL10_(G4S)_huIL10_(G4S)2_Fc(216)_IgG1_pI(-
)_Isosteric_A_C220S/PVA_/S267K/L368D/K370S (SEQ ID NO: 370)

SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN/GGGGS/SPGQGTQSENSCTHFPGNLPNMLRDLRDAFSRVKTFFQMKDQLDNLLLKESLLEDFKGYLGCQA
LSEMIQFYLEEVMPQAENQDPDIKAHVNSLGENLKTLRLRLRRCLRFLPCENKSKAVEQVKNAFNKLQEKGIYKAMS
EFDIFINYIEAYMTMKIRN/GGGGSGGGGS/EPKSSDKTHTCPPCPAPPVAGPSVFLFPPKPKDTLMISRTPEVTCV
VVDVKHEDPEVKFNWYVDGVEVHNAKTKPREEEYNSTYRVVSVLTVLHQDWLNGKEYKCKVSNKALPAPIEKTISKA
KGQPREPQVYTLPPSREEMTKNQVSLTCDVSGFYPSDIAVEWESDGQPENNYKTTPPVLDSDGSFFLYSKLTVDKSR
WEQGDVFSCSVMHEALHNHYTQKSLSLSPGK

XENP25239 Chain 2 - empty_Fc(216)_IgG1_C220S/PVA_/S267K/S364K/E357Q (SEQ ID NO: 371)

EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 49B

>XENP25240 huIL10_(G4S)2_huIL10_(G4S)2-empty_Fc(216)_IgG1_pI(-
)_Isosteric_A_C220S/PVA_/S267K/L368D/K370S-IgG1_C220S/PVA_/S267K/S364K/E357Q XENP25240 Chain 1 - huIL10_(G4S)2_huIL10_(G4S)2_Fc(216)_IgG1_pI(-
)_Isosteric_A_C220S/PVA_/S267K/L368D/K370S  (SEQ ID NO: 372)

*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN/GGGGSGGGGS/SPGQGTQSENSCTHFPGNLPNMLRDLRDAFSRVKTFFQMKDQLDNLLLKESLLEDFKGY
LGCQALSEMIQFYLEEVMPQAENQDPDIKAHVNSLGENLKTLRLRLRRCLRFLPCENKSKAVEQVKNAFNKLQEKGI
YKAMSEFDIFINYIEAYMTMKIRN/GGGGSGGGGS/EPKSSDKTHTCPPCPAPPVAGPSVFLFPPKPKDTLMISRTP
EVTCVVVDVKHEDPEVKFNWYVDGVEVHNAKTKPREEEYNSTYRVVSVLTVLHQDWLNGKEYKCKVSNKALPAPIEK
TISKAKGQPREPQVYTLPPSREEMTKNQVSLTCDVSGFYPSDIAVEWESDGQPENNYKTTPPVLDSDGSFFLYSKLT
VDKSRWEQGDVFSCSVMHEALHNHYTQKSLSLSPGK*

XENP25240 Chain 2 - empty_Fc(216)_IgG1_C220S/PVA_/S267K/S364K/E357Q  (SEQ ID NO: 373)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK >XENP25241 huIL10_(G4S)3_huIL10_(G4S)2-empty_Fc(216)_IgG1_pI(-
)_Isosteric_A_C220S/PVA_/S267K/L368D/K370S-IgG1_C220S/PVA_/S267K/S364K/E357Q XENP25241 Chain 1 - huIL10_(G4S)3_huIL10_(G4S)2_Fc(216)_IgG1_pI(-
)_Isosteric_A_C220S/PVA_/S267K/L368D/K370S  (SEQ ID NO: 374)

*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN/GGGGSGGGGSGGGGS/SPGQGTQSENSCTHFPGNLPNMLRDLRDAFSRVKTFFQMKDQLDNLLLKESLLE
DFKGYLGCQALSEMIQFYLEEVMPQAENQDPDIKAHVNSLGENLKTLRLRLRRCLRFLPCENKSKAVEQVKNAFNKL
QEKGIYKAMSEFDIFINYIEAYMTMKIRN/GGGGSGGGGS/EPKSSDKTHTCPPCPAPPVAGPSVFLFPPKPKDTLM
ISRTPEVTCVVVDVKHEDPEVKFNWYVDGVEVHNAKTKPREEEYNSTYRVVSVLTVLHQDWLNGKEYKCKVSNKALP
APIEKTISKAKGQPREPQVYTLPPSREEMTKNQVSLTCDVSGFYPSDIAVEWESDGQPENNYKTTPPVLDSDGSFFL
YSKLTVDKSRWEQGDVFSCSVMHEALHNHYTQKSLSLSPGK*

XENP25241 Chain 2 - empty_Fc(216)_IgG1_C220S/PVA_/S267K/S364K/E357Q  (SEQ ID NO: 375)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK Figure 50A-Figure 50E
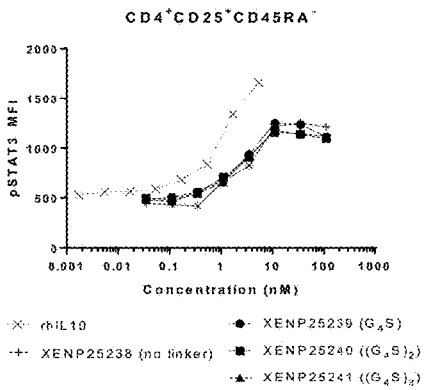
Fig. 50A)
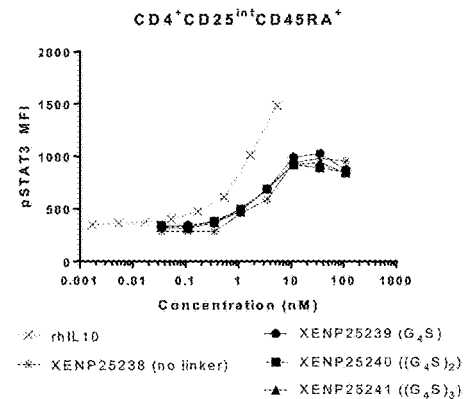
Fig. 50B)
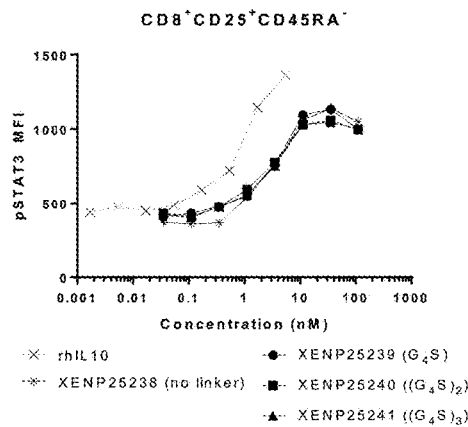
Fig. 50C)
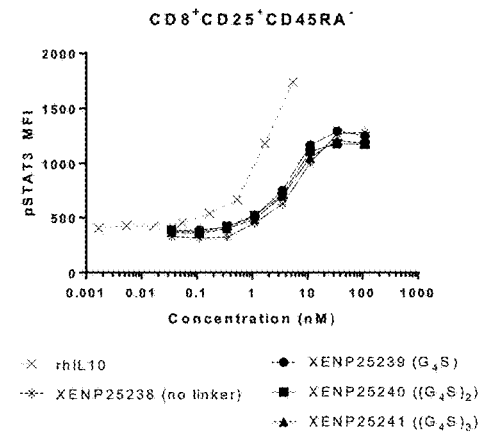
Fig. 50D)
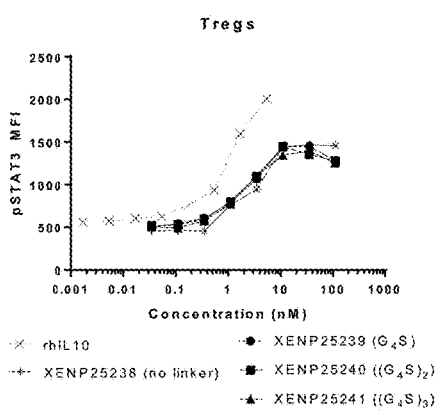
Fig. 50E)

Figure 52

| XENP | Batch | Total Protein Yield (mg/L) | Homodimer % | Heterodimer % | Homodimer Yield (mg/L) | Heterodimer Yield (mg/L) |
|---|---|---|---|---|---|---|
| 25880 | 20170829 | 22.93 | 78.27% | 21.74% | 17.95 | 4.99 |
|  | 20170919 | 68.61 | 86.87% | 11.79% | 59.60 | 8.09 |
|  | 20170926 | 11.61 | 78.61% | 24.49% | 9.13 | 2.84 |
|  | 20180115 | 18.45 | 55.51% | 44.49% | 10.24 | 8.21 |
|  | 20180213 | 16.31 | 58.88% | 41.12% | 9.61 | 6.71 |
|  | 20180403 | 7.87 | 59.78% | 40.22% | 4.70 | 3.16 |
|  | 20180605 | 9.38 | 7.60% | 48.09% | 0.71 | 4.51 |
| 25981 | 20180115 | 26.20 | 16.25% | 83.75% | 4.26 | 21.94 |
|  | 20180213 | 43.39 | 25.66% | 73.05% | 11.13 | 31.70 |
|  | 20180320 | 29.67 | 16.19% | 82.97% | 4.80 | 24.62 |
|  | 20180403 | 69.07 | 34.72% | 65.28% | 23.98 | 45.09 |
|  | 20180509 | 48.24 | 28.14% | 68.58% | 13.58 | 33.08 |
|  | 20180523 | 5.73 | 67.79% | 32.21% | 3.89 | 1.85 |
|  | 20170919 | 122.11 | 63.00% | 36.10% | 76.93 | 44.08 |

Figure 53

>XENP25986 empty_Fc(216)-huIL10.38_huIL10.38_(G4S)2_IgG1_pI(-
)_Isosteric_A_C220S/PVA_/S267K/L368D/K370S-IgG1_C220S/PVA_/S267K/S364K/E357Q

Chain 1 - empty_Fc(216)_pI(-)_Isosteric_A_C220S/PVA_/S267K/L368D/K370S (SEQ ID NO: 376)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.38_huIL10.38_(G4S)2_IgG1_C220S/PVA_/S267K/S364K/E357Q (SEQ ID NO: 377)
*SPGQGTQSENSCTHFPGNLPNMLRDLRDAFSRVKTFFEMKDQLDDLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIEAYM*
*TMKIRNSPGQGTQSENSCTHFPGNLPNMLRDLRDAFSRVKTFFEMKDQLDDLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTMKIRN\GGGGSGGGGS\EPKSSDKTHTCPPCPAPPVAGPSVFLFPPKPKDTLMISRTPEVTCVVVDVKHE*
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP25993 empty_Fc(216)-huIL10.45_huIL10.45_(G4S)2_IgG1_pI(-
)_Isosteric_A_C220S/PVA_/S267K/L368D/K370S-IgG1_C220S/PVA_/S267K/S364K/E357Q

Chain 1 - empty_Fc(216)_pI(-)_Isosteric_A_C220S/PVA_/S267K/L368D/K370S (SEQ ID NO: 378)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.45_huIL10.45_(G4S)2_C220S/PVA_/S267K/S364K/E357Q (SEQ ID NO: 379)
*SPGQGTQSENSCTHFPGNLPNMLRDLRDAFSRVKTFFQMKDELDDLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIEAYM*
*TMKIRNSPGQGTQSENSCTHFPGNLPNMLRDLRDAFSRVKTFFQMKDELDDLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTMKIRN\GGGGSGGGGS\EPKSSDKTHTCPPCPAPPVAGPSVFLFPPKPKDTLMISRTPEVTCVVVDVKHE*
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Figure 54

| XENP | Batch | Total Protein Yield (mg/L) | Homodimer % | Heterodimer % | Homodimer Yield (mg/L) | Heterodimer Yield (mg/L) |
|---|---|---|---|---|---|---|
| 25880 (WT) | 20180213 | 16.31 | 58.88% | 41.12% | 9.61 | 6.71 |
| 25981 (N45D/ N205D) | 20180213 | 43.39 | 25.66% | 73.05% | 11.13 | 31.70 |
| 25986 (Q38E/ N45D/ Q198E/ N205D) | 20180213 | 50.07 | 17.70% | 82.30% | 8.86 | 41.21 |
| 25993 (Q42E/ N45D/ Q202E/ N205D) | 20180213 | 26.07 | 32.59% | 67.41% | 8.50 | 17.57 |

Figure 55

> huIL10(N10A) (SEQ ID NO: 380)
SPGQGTQSEASCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> huIL10(N10Q) (SEQ ID NO: 381)
SPGQGTQSEQSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

> huIL10(N92A) (SEQ ID NO: 382)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVASLGENLKTLRLRLRRCLRFLPCENKSKAVEQVKNAFNKLQEKGIYKAMSEFDIFINYIEAYM
TMKIRN

> huIL10(N126A) (SEQ ID NO: 383)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKAAFNKLQEKGIYKAMSEFDIFINYIEAYM
TMKIRN

> huIL10(N160A) (SEQ ID NO: 384)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRA

Figure 56A

> huIL10.83(N10A/N45D/N170A/N205D) (SEQ ID NO: 385)

SPGQGTQSEASCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSEASCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.85(N45D/N92A/N205D/N252A) (SEQ ID NO: 386)

SPGQGTQSENSCTHFPGNLPNMLRDLRDAFSRVKTFFQMKDQLDDLLLKESLLEDFKGYLGCQALSEMIQFYLEEVM
PQAENQDPDIKAHVASLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVASLGENLKTLRLRLRRCLRFLPCENKSKAVEQVKNAFNKLQEKGIYKAMSEFDIFIN
YIEAYMTMKIRN

> huIL10.86(N45D/N126A/N205D/N286A) (SEQ ID NO: 387)

SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKAAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKAAFNKLQEKGIYKAMSEFDIFIN
YIEAYMTMKIRN

> huIL10.87(N45D/N160A/N205D) (SEQ ID NO: 388)

SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRASPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.88(N45D/N205D/N320A) (SEQ ID NO: 389)

SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRA

> huIL10.89(N45D/N160A/N205D/N320A) (SEQ ID NO: 390)

SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRASPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRA

Figure 56B

> huIL10.90(N10A/N45D/N170A/N205D/N320A) (SEQ ID NO: 391)

SPGQGTQSEASCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSEASCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRA

> huIL10.91(N10A/N45D/N170A/N205D/N320_) (SEQ ID NO: 392)

SPGQGTQSEASCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSEASCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIR

> huIL10.92(N10A/N45D/N170A/N205D/R319_/N320_) (SEQ ID NO: 393)

SPGQGTQSEASCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSEASCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKI

> huIL10.93(N10A/N45D/N170A/N205D/I318_/R319_/N320_) (SEQ ID NO: 394)

SPGQGTQSEASCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSEASCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMK

> huIL10.94(N10A/N45D/N170A/N205D/K317_/I318_/R319_/N320_) (SEQ ID NO: 395)

SPGQGTQSEASCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSEASCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTM

> huIL10.95(N10A/N45D/N205D/N320A) (SEQ ID NO: 396)

SPGQGTQSEASCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRA

Figure 56C

> huIL10.96(N45D/N170A/N205D/N320A) (SEQ ID NO: 397)

SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSEASCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRA

> huIL10.97(N10Q/N45D/N170Q/N205D/N320A) (SEQ ID NO: 398)

SPGQGTQSEQSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSEQSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRA

Figure 57

> huIL10 (D28A) (SEQ ID NO: 399)

SPGQGTQSENSCTHFPGNLPNMLRDLRAAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN

Figure 58

> huIL10.84 (D28A/N45D/D188A/N205D) (SEQ ID NO: 400)

SPGQGTQSENSCTHFPGNLPNMLRDLRAAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRAAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

Figure 59A

>XENP28295 empty-huIL10_huIL10-Fc(216)_IgG1_pI(-)_Isosteric_A_PVA_/S267K/L368D/K370S-Fc(216)_IgG1_C220S/PVA_/S267K/S364K/E357Q

XENP28295 Chain 1 - empty_Fc(216)_IgG1_pI(-)_Isosteric_A_PVA_/S267K/L368D/K370S (SEQ ID NO: 401)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

XENP28295 Chain 2 - huIL10_huIL10_Fc(216)_IgG1_C220S/PVA_/S267K/S364K/E357Q (SEQ ID NO: 402)
*SPGQGTQSENSCTHFPGNLPNMLRDLRDAFSRVKTFFQMKDQLDNLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIEAYM*
*TMKIRNSPGQGTQSENSCTHFPGNLPNMLRDLRDAFSRVKTFFQMKDQLDNLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

>XENP28635 empty_Fc(216)-huIL10.83_huIL10.83_(G4S)2_IgG1_pI(-)_Isosteric_A_C220S/PVA_/S267K/L368D/K370S-IgG1_C220S/PVA_/S267K/S364K/E357Q

Chain 1 - empty_Fc(216)_pI(-)_Isosteric_A_C220S/PVA_/S267K/L368D/K370S (SEQ ID NO: 403)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.83_huIL10.83_(G4S)2_IgG1_C220S/PVA_/S267K/S364K/E357Q (SEQ ID NO: 404)
*SPGQGTQSEASCTHFPGNLPNMLRDLRDAFSRVKTFFQMKDQLDDLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIEAYM*
*TMKIRNSPGQGTQSEASCTHFPGNLPNMLRDLRDAFSRVKTFFQMKDQLDDLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTMKIRN*\<u>GGGGSGGGGS</u>\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

>XENP28636 empty_Fc(216)-huIL10.84_huIL10.84_(G4S)2_IgG1_pI(-)_Isosteric_A_C220S/PVA_/S267K/L368D/K370S-IgG1_C220S/PVA_/S267K/S364K/E357Q

Chain 1 - empty_Fc(216)_pI(-)_Isosteric_A_C220S/PVA_/S267K/L368D/K370S (SEQ ID NO: 405)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Figure 59B

Chain 2 - huIL10.84_huIL10.84_(G4S)2_IgG1_C220S/PVA_/S267K/S364K/E357Q (SEQ ID NO: 406)
*SPGQGTQSENSCTHFPGNLPNMLRDLRAAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRAAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

>XENP28637 empty_Fc(216)-huIL10.85_huIL10.85_(G4S)2_IgG1_pI(-)_Isosteric_A_C220S/PVA_/S267K/L368D/K370S-IgG1_C220S/PVA_/S267K/S364K/E357Q

Chain 1 - empty_Fc(216)_pI(-)_Isosteric_A_C220S/PVA_/S267K/L368D/K370S (SEQ ID NO: 407)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.85_huIL10.85_(G4S)2_IgG1_C220S/PVA_/S267K/S364K/E357Q (SEQ ID NO: 408)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVASLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVASLGENLKTLRLRLRRCLRFLPCENKSKAVEQVKNAFNKLQEKGIYKAMSEFDIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

>XENP28638 empty_Fc(216)-huIL10.86_huIL10.86_(G4S)2_IgG1_pI(-)_Isosteric_A_C220S/PVA_/S267K/L368D/K370S-IgG1_C220S/PVA_/S267K/S364K/E357Q

Chain 1 - empty_Fc(216)_pI(-)_Isosteric_A_C220S/PVA_/S267K/L368D/K370S (SEQ ID NO: 409)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.86_huIL10.86_(G4S)2_IgG1_C220S/PVA_/S267K/S364K/E357Q (SEQ ID NO: 410)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKAAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKAAFNKLQEKGIYKAMSEFDIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Figure 59C

>XENP28639 empty_Fc(216)-huIL10.87_huIL10.87_(G4S)2_IgG1_pI(-
)_Isosteric_A_C220S/PVA_/S267K/L368D/K370S-IgG1_C220S/PVA_/S267K/S364K/E357Q

Chain 1 - empty_Fc(216)_pI(-)_Isosteric_A_C220S/PVA_/S267K/L368D/K370S (SEQ ID NO: 411)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.87_huIL10.87_(G4S)2_IgG1_C220S/PVA_/S267K/S364K/E357Q (SEQ ID NO: 412)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRASPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP28640 empty_Fc(216)-huIL10.88_huIL10.88_(G4S)2_IgG1_pI(-
)_Isosteric_A_C220S/PVA_/S267K/L368D/K370S-IgG1_C220S/PVA_/S267K/S364K/E357Q

Chain 1 - empty_Fc(216)_pI(-)_Isosteric_A_C220S/PVA_/S267K/L368D/K370S (SEQ ID NO: 413)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.88_huIL10.88_(G4S)2_IgG1_C220S/PVA_/S267K/S364K/E357Q (SEQ ID NO: 414)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRA*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP28641 empty_Fc(216)-huIL10.89_huIL10.89_(G4S)2_IgG1_pI(-
)_Isosteric_A_C220S/PVA_/S267K/L368D/K370S-IgG1_C220S/PVA_/S267K/S364K/E357Q

Chain 1 - empty_Fc(216)_pI(-)_Isosteric_A_C220S/PVA_/S267K/L368D/K370S (SEQ ID NO: 415)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Figure 59D

Chain 2 - huIL10.89_huIL10.89_(G4S)2_IgG1_C220S/PVA_/S267K/S364K/E357Q (SEQ ID NO: 416)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRASPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRA\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

>XENP28895 empty-huIL10.90_huIL10.90_(G4S)2-Fc(216)_IgG1_pI(-
)_Isosteric_A_C220S/PVA_/S267K/L368D/K370S-Fc(216)_IgG1_C220S/PVA_/S267K/S364K/E357Q

Chain 1 - empty_Fc(216)_pI(-)_Isosteric_A_C220S/PVA_/S267K/L368D/K370S (SEQ ID NO: 417)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.90_huIL10.90_(G4S)2_Fc(216)_IgG1_C220S/PVA_/S267K/S364K/E357Q (SEQ ID NO: 418)
*SPGQGTQSEASCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSEASCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRA\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

>XENP28896 empty-huIL10.91_huIL10.91_(G4S)2-Fc(216)_IgG1_pI(-
)_Isosteric_A_C220S/PVA_/S267K/L368D/K370S-Fc(216)_IgG1_C220S/PVA_/S267K/S364K/E357Q

Chain 1 - empty_Fc(216)_pI(-)_Isosteric_A_C220S/PVA_/S267K/L368D/K370S (SEQ ID NO: 419)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.91_huIL10.91_(G4S)2_Fc(216)_IgG1_C220S/PVA_/S267K/S364K/E357Q (SEQ ID NO: 420)
*SPGQGTQSEASCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSEASCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIR\GGGGSGGGGS\EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK*

Figure 59E

**>XENP28897 empty-huIL10.92_huIL10.92_(G4S)2-Fc(216)_IgG1_pI(-
)_Isosteric_A_C220S/PVA_/S267K/L368D/K370S-Fc(216)_IgG1_C220S/PVA_/S267K/S364K/E357Q**

Chain 1 - empty_Fc(216)_pI(-)_Isosteric_A_C220S/PVA_/S267K/L368D/K370S (SEQ ID NO: 421)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.92_huIL10.92_(G4S)2_Fc(216)_IgG1_C220S/PVA_/S267K/S364K/E357Q (SEQ ID NO: 422)
*SPGQGTQSEASCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSEASCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKI*\GGGGSGGGGS\EPKSSDKTHTCPPCPAPPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREPQV
YTLPPSREQMTKNQVKLTCLVKGFYPSDIAVEWESNGQPENNYKTTPPVLDSDGSFFLYSKLTVDKSRWQQGNVFSC
SVMHEALHNHYTQKSLSLSPGK

**>XENP28898 empty-huIL10.93_huIL10.93_(G4S)2-Fc(216)_IgG1_pI(-
)_Isosteric_A_C220S/PVA_/S267K/L368D/K370S-Fc(216)_IgG1_C220S/PVA_/S267K/S364K/E357Q**

Chain 1 - empty_Fc(216)_pI(-)_Isosteric_A_C220S/PVA_/S267K/L368D/K370S (SEQ ID NO: 423)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.93_huIL10.93_(G4S)2_Fc(216)_IgG1_C220S/PVA_/S267K/S364K/E357Q (SEQ ID NO: 424)
*SPGQGTQSEASCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSEASCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMK*\GGGGSGGGGS\EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

**>XENP28899 empty-huIL10.94_huIL10.94_(G4S)2-Fc(216)_IgG1_pI(-
)_Isosteric_A_C220S/PVA_/S267K/L368D/K370S-Fc(216)_IgG1_C220S/PVA_/S267K/S364K/E357Q**

Chain 1 - empty_Fc(216)_pI(-)_Isosteric_A_C220S/PVA_/S267K/L368D/K370S (SEQ ID NO: 425)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Figure 59F

Chain 2 - huIL10.94_huIL10.94_(G4S)2_Fc(216)_IgG1_C220S/PVA_/S267K/S364K/E357Q (SEQ ID NO: 426)
*SPGQGTQSEASCTHFPGNLPNMLRDLRDAFSRVKTFFQMKDQLDDLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIEAYM*
*TMKIRNSPGQGTQSEASCTHFPGNLPNMLRDLRDAFSRVKTFFQMKDQLDDLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTM*\GGGGSGGGGS\EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

>XENP28900 empty-huIL10.95_huIL10.95_(G4S)2-Fc(216)_IgG1_pI(-
)_Isosteric_A_C220S/PVA_/S267K/L368D/K370S-Fc(216)_IgG1_C220S/PVA_/S267K/S364K/E357Q

Chain 1 - empty_Fc(216)_pI(-)_Isosteric_A_C220S/PVA_/S267K/L368D/K370S (SEQ ID NO: 427)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.95_huIL10.95_(G4S)2_Fc(216)_IgG1_C220S/PVA_/S267K/S364K/E357Q (SEQ ID NO: 428)
*SPGQGTQSEASCTHFPGNLPNMLRDLRDAFSRVKTFFQMKDQLDDLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIEAYM*
*TMKIRNSPGQGTQSENSCTHFPGNLPNMLRDLRDAFSRVKTFFQMKDQLDDLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTMKIRA*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

>XENP28901 empty-huIL10.96_huIL10.96_(G4S)2-Fc(216)_IgG1_pI(-
)_Isosteric_A_C220S/PVA_/S267K/L368D/K370S-Fc(216)_IgG1_C220S/PVA_/S267K/S364K/E357Q

Chain 1 - empty_Fc(216)_pI(-)_Isosteric_A_C220S/PVA_/S267K/L368D/K370S (SEQ ID NO: 429)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.96_huIL10.96_(G4S)2_Fc(216)_IgG1_C220S/PVA_/S267K/S364K/E357Q (SEQ ID NO: 430)
*SPGQGTQSENSCTHFPGNLPNMLRDLRDAFSRVKTFFQMKDQLDDLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIEAYM*
*TMKIRNSPGQGTQSEASCTHFPGNLPNMLRDLRDAFSRVKTFFQMKDQLDDLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTMKIRA*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Figure 59G

>XENP28902 empty-huIL10.97_huIL10.97_(G4S)2-Fc(216)_IgG1_pI(-
)_Isosteric_A_C220S/PVA_/S267K/L368D/K370S-Fc(216)_IgG1_C220S/PVA_/S267K/S364K/E357Q Chain 1 - empty_Fc(216)_pI(-)_Isosteric_A_C220S/PVA_/S267K/L368D/K370S (SEQ ID NO: 431)
EPKSSDKTHTCPPCPAPPVAGPSVFLFPPKPKDTLMISRTPEVTCVVVDVKHEDPEVKFNWYVDGVEVHNAKTKPRE
EYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.97_huIL10.97_(G4S)2_Fc(216)_IgG1_C220S/PVA_/S267K/S364K/E357Q (SEQ ID NO: 432)
*SPGQGTQSEQSCTHFPGNLPNMLRDLRDAFSRVKTFFQMKDQLDDLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIEAYM*
*TMKIRNSPGQGTQSEQSCTHFPGNLPNMLRDLRDAFSRVKTFFQMKDQLDDLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTMKIRA*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP28904 empty-huIL10.22_huIL10.22-Fc(216)_IgG1_pI(-)_Isosteric_A_C220S/PVA_/S267K/L368D/K370S-
Fc(216)_IgG1_C220S/PVA_/S267K/S364K/E357Q XENP28904 Chain 1 - empty_Fc(216)_IgG1_pI(-)_Isosteric_A_C220S/PVA_/S267K/L368D/K370S (SEQ ID NO: 433)
EPKSSDKTHTCPPCPAPPVAGPSVFLFPPKPKDTLMISRTPEVTCVVVDVKHEDPEVKFNWYVDGVEVHNAKTKPRE
EYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP28904 Chain 2 - huIL10.22_huIL10.22-Fc(216)_Fc(216)_IgG1_C220S/PVA_/S267K/S364K/E357Q (SEQ ID NO: 434)
*SPGQGTQSENSCTHFPGNLPNMLRDLRDAFSRVKTFFQMKDQLDDLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIEAYM*
*TMKIRNSPGQGTQSENSCTHFPGNLPNMLRDLRDAFSRVKTFFQMKDQLDDLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 59H

>XENP28905    empty-huIL10.83_huIL10.83-Fc(216)_IgG1_pI(-)_Isosteric_A_C220S/PVA_/S267K/L368D/K370S-Fc(216)_IgG1_C220S/PVA_/S267K/S364K/E357Q

XENP28905 Chain 1 - empty_Fc(216)_IgG1_pI(-)_Isosteric_A_C220S/PVA_/S267K/L368D/K370S (SEQ ID NO: 435)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP28905 Chain 2 - huIL10.83_huIL10.83-Fc(216)__IgG1_C220S/PVA_/S267K/S364K/E357Q (SEQ ID NO: 436)
*SPGQGTQSEASCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSEASCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK*

Figure 60

>XENP28906 empty_Fc(216)-pI(-)_Isosteric_A_C220S/PVA_/S267K/L368D/K370S-IgG1_C220S/PVA_/S267K/S364K/E357Q/K447del_(G4S)3_huIL10.83_huIL10.83

XENP28906 Chain 1 - empty_Fc(216)-pI(-)_Isosteric_A_C220S/PVA_/S267K/L368D/K370S (SEQ ID NO: 437)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP28906 Chain 2 - Fc(216)_IgG1_C220S/PVA_/S267K/S364K/E357Q/K447del_(G4S)3_huIL10.83_huIL10.83 (SEQ ID NO: 438)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
<u>GGGGSGGGGSGGGGS</u>/*SPGQGTQSEASCTHFPGNLPNMLRDLRDAFSRVKTFFQMKDQLDDLLLKESLLEDFKGYLG
CQALSEMIQFYLEEVMPQAENQDPDIKAHVNSLGENLKTLRLRLRRCLRFLPCENKSKAVEQVKNAFNKLQEKGIYK
AMSEFDIFINYIEAYMTMKIRNSPGQGTQSEASCTHFPGNLPNMLRDLRDAFSRVKTFFQMKDQLDDLLLKESLLED
FKGYLGCQALSEMIQFYLEEVMPQAENQDPDIKAHVNSLGENLKTLRLRLRRCLRFLPCENKSKAVEQVKNAFNKLQ
EKGIYKAMSEFDIFINYIEAYMTMKIRN*

Figure 61A-Figure 61D
Figure 61A
| XENP | aCIEX Chromatogram |
|---|---|
| A) XENP25981 (N45D/N205D) | 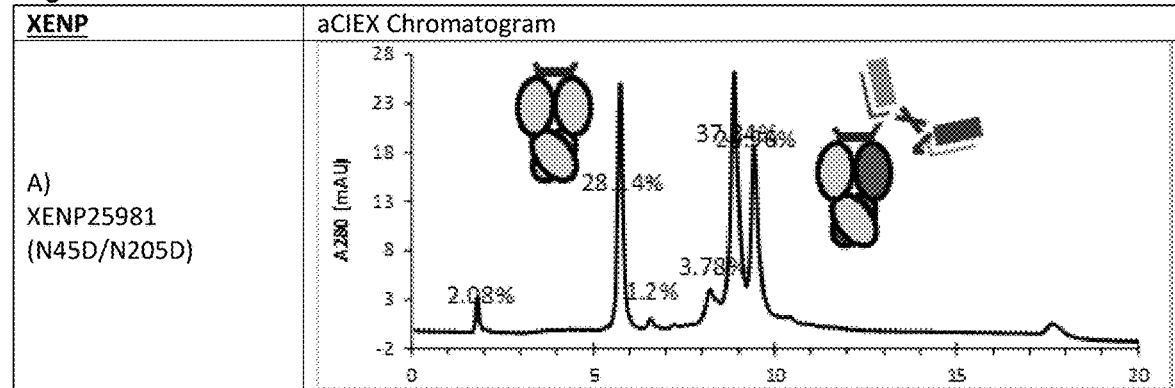 |
Figure 61B
| B) XENP28295 (WT; no linker) | 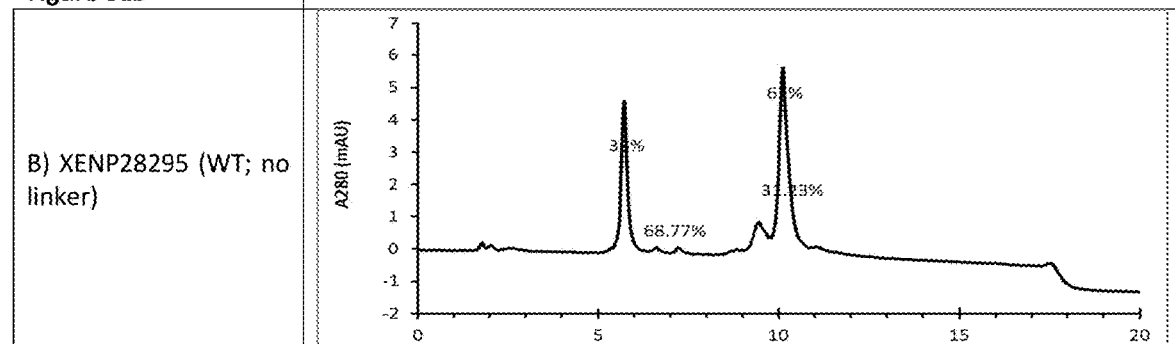 |
|---|---|
Figure 61C
| C) XENP28641 (N45D/N160A/ N205D/N320A) | 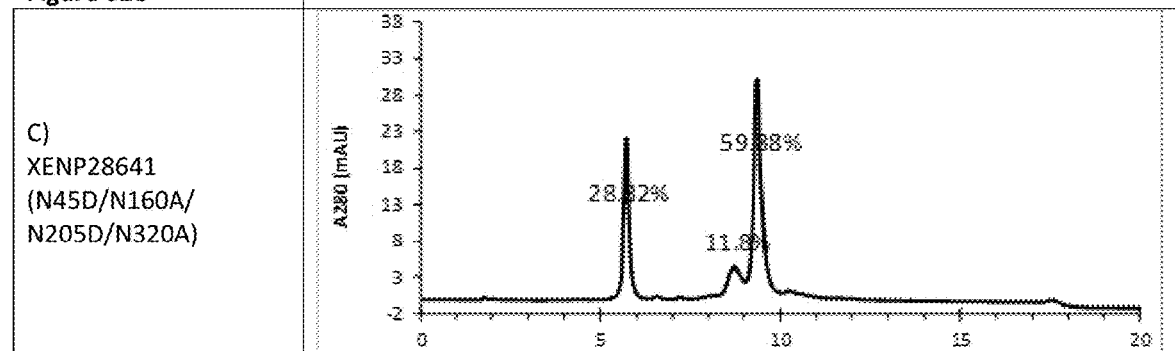 |
|---|---|
Figure 61D
| D) XENP28635 (N10A/N45D/ N170A/N205D) | 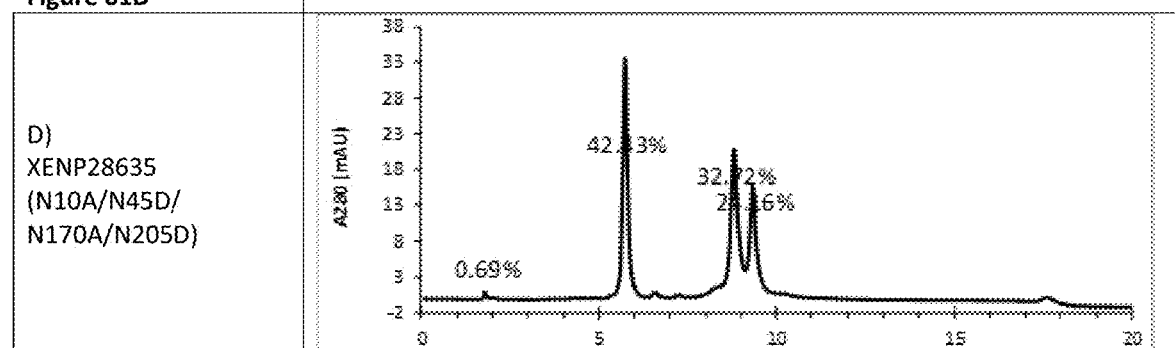 |
|---|---|

Figure 62A-Figure 62E
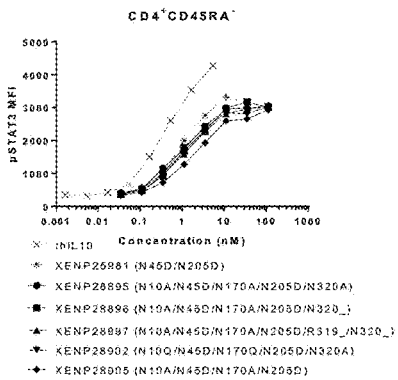
Fig. 62A)
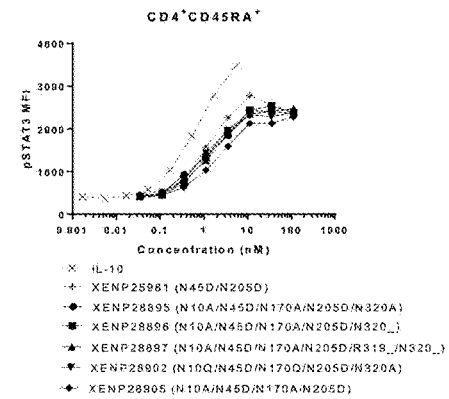
Fig. 62B)
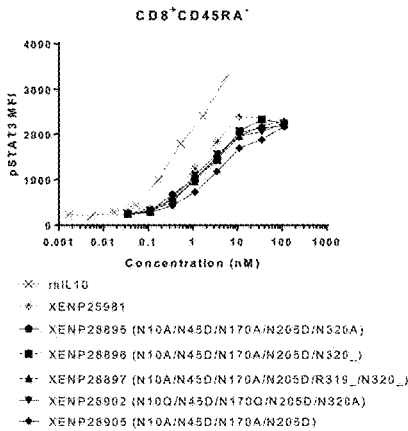
Fig. 62C)
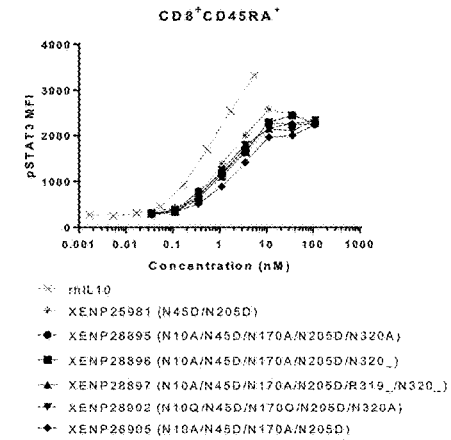
Fig. 62D)
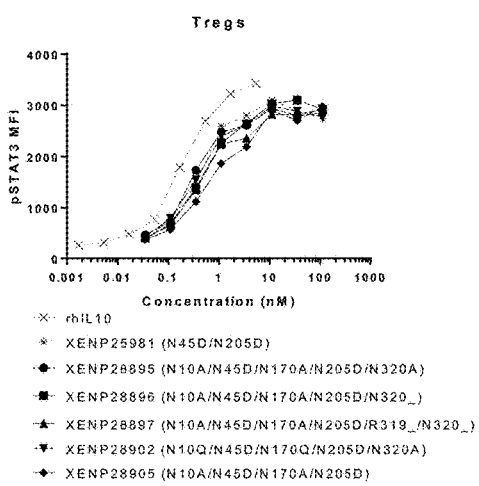
Fig. 62E)

Figure 64

> huIL10(N116D) (SEQ ID NO: 439)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCEDKSKAVEQVKNAFNKLQEKGIYKAMSEFDIFINYIEAYM
TMKIRN

> huIL10(N116Q) (SEQ ID NO: 440)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCEQKSKAVEQVKNAFNKLQEKGIYKAMSEFDIFINYIEAYM
TMKIRN

> huIL10(K117P) (SEQ ID NO: 441)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENPSKAVEQVKNAFNKLQEKGIYKAMSEFDIFINYIEAYM
TMKIRN

> huIL10(S118A) (SEQ ID NO: 442)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKAKAVEQVKNAFNKLQEKGIYKAMSEFDIFINYIEAYM
TMKIRN

Figure 65A

> huIL10.74 (N45D/N116D/N205D) (SEQ ID NO: 443)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCEDKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.75 (N45D/N116Q/N205D) (SEQ ID NO: 444)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCEQKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.76 (N45D/K117P/N205D) (SEQ ID NO: 445)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENPSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.77 (N45D/S118A/N205D) (SEQ ID NO: 446)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKAKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN

> huIL10.78 (N45D/N205D/N276D) (SEQ ID NO: 447)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCEDKSKAVEQVKNAFNKLQEKGIYKAMSEFDIFIN
YIEAYMTMKIRN

> huIL10.79 (N45D/N205D/N276Q) (SEQ ID NO: 448)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCEQKSKAVEQVKNAFNKLQEKGIYKAMSEFDIFIN
YIEAYMTMKIRN

Figure 65B

> huIL10.80 (N45D/N205D/K277P) (SEQ ID NO: 449)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENPSKAVEQVKNAFNKLQEKGIYKAMSEFDIFIN
YIEAYMTMKIRN

> huIL10.81 (N45D/N205D/S178A) (SEQ ID NO: 450)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKAKAVEQVKNAFNKLQEKGIYKAMSEFDIFIN
YIEAYMTMKIRN

> huIL10.82 (N45D/N116D/N205D/N276D) (SEQ ID NO: 451)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCEDKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCEDKSKAVEQVKNAFNKLQEKGIYKAMSEFDIFIN
YIEAYMTMKIRN

Figure 66A

>XENP28006_empty_Fc(216)-huIL10.74_huIL10.74_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S (SEQ ID NO: 452)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.74_huIL10.74_(G4S)2_IgG1_C220S/PVA_/S267K/S364K/E357Q (SEQ ID NO: 453)
*SPGQGTQSENSCTHFPGNLPNMLRDLRDAFSRVKTFFQMKDQLDDLLLKESLLEDFKGYLGCQALSEMIQFYLEEVM*
*PQAENQDPDIKAHVNSLGENLKTLRLRLRRCLRFLPCEDKSKAVEQVKNAFNKLQEKGIYKAMSEFDIFINYIEAYM*
*TMKIRNSPGQGTQSENSCTHFPGNLPNMLRDLRDAFSRVKTFFQMKDQLDDLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP28007_empty_Fc(216)-huIL10.75_huIL10.75_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S (SEQ ID NO: 454)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.75_huIL10.75_(G4S)2_IgG1_C220S/PVA_/S267K/S364K/E357Q (SEQ ID NO: 455)
*SPGQGTQSENSCTHFPGNLPNMLRDLRDAFSRVKTFFQMKDQLDDLLLKESLLEDFKGYLGCQALSEMIQFYLEEVM*
*PQAENQDPDIKAHVNSLGENLKTLRLRLRRCLRFLPCEQKSKAVEQVKNAFNKLQEKGIYKAMSEFDIFINYIEAYM*
*TMKIRNSPGQGTQSENSCTHFPGNLPNMLRDLRDAFSRVKTFFQMKDQLDDLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Figure 66B

>XENP28008_empty_Fc(216)-huIL10.76_huIL10.76_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S  (SEQ ID NO: 456)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.76_huIL10.76_(G4S)2_IgG1_C220S/PVA_/S267K/S364K/E357Q  (SEQ ID NO: 457)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENPSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK >XENP28009_empty_Fc(216)-huIL10.77_huIL10.77_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S  (SEQ ID NO: 458)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.77_huIL10.77_(G4S)2_IgG1_C220S/PVA_/S267K/S364K/E357Q  (SEQ ID NO: 459)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKAKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Figure 66C

>XENP28010 empty_Fc(216)-huIL10.78_huIL10.78_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S  (SEQ ID NO: 460)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.78_huIL10.78_(G4S)2_IgG1_C220S/PVA_/S267K/S364K/E357Q  (SEQ ID NO: 461)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCEDKSKAVEQVKNAFNKLQEKGIYKAMSEFDIFIN
YIEAYMTMKIRN\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

>XENP28011 empty_Fc(216)-huIL10.79_huIL10.79_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S  (SEQ ID NO: 462)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.79_huIL10.79_(G4S)2_IgG1_C220S/PVA_/S267K/S364K/E357Q  (SEQ ID NO: 463)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCEQKSKAVEQVKNAFNKLQEKGIYKAMSEFDIFIN
YIEAYMTMKIRN\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

>XENP28012 empty_Fc(216)-huIL10.80_huIL10.80_(G4S)2_IgG1_pI(-
)_Isosteric_A_C220S/PVA_/S267K/L368D/K370S-IgG1_C220S/PVA_/S267K/S364K/E357Q Chain 1 - empty_Fc(216)_pI(-)_Isosteric_A_C220S/PVA_/S267K/L368D/K370S  (SEQ ID NO: 464)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Figure 66D

Chain 2 - huIL10.80_huIL10.80_(G4S)2_IgG1_C220S/PVA_/S267K/S364K/E357Q (SEQ ID NO: 465)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENPSKAVEQVKNAFNKLQEKGIYKAMSEFDIFIN
YIEAYMTMKIRN\<u>GGGGSGGGGS</u>\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

**>XENP28013 empty_Fc(216)-huIL10.81_huIL10.81_(G4S)2_IgG1_pI(-
)_Isosteric_A_C220S/PVA_/S267K/L368D/K370S-IgG1_C220S/PVA_/S267K/S364K/E357Q**

Chain 1 - empty_Fc(216)_pI(-)_Isosteric_A_C220S/PVA_/S267K/L368D/K370S (SEQ ID NO: 466)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.81_huIL10.81_(G4S)2_IgG1_C220S/PVA_/S267K/S364K/E357Q (SEQ ID NO: 467)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKAKAVEQVKNAFNKLQEKGIYKAMSEFDIFIN
YIEAYMTMKIRN\<u>GGGGSGGGGS</u>\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

**>XENP28014 empty_Fc(216)-huIL10.82_huIL10.82_(G4S)2_IgG1_pI(-
)_Isosteric_A_C220S/PVA_/S267K/L368D/K370S-IgG1_C220S/PVA_/S267K/S364K/E357Q**

Chain 1 - empty_Fc(216)_pI(-)_Isosteric_A_C220S/PVA_/S267K/L368D/K370S (SEQ ID NO: 468)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10.82_huIL10.82_(G4S)2_IgG1_C220S/PVA_/S267K/S364K/E357Q (SEQ ID NO: 469)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCEDKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCEDKSKAVEQVKNAFNKLQEKGIYKAMSEFDIFIN
YIEAYMTMKIRN\<u>GGGGSGGGGS</u>\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

Figure 67

> huIL10.98(C12A/ C108A) (SEQ ID NO: 470)

SPGQGTQSENSATHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRALRFLPCENKSKAVEQVKNAFNKLQEKGIYKAMSEFDIFINYIEAYM
TMKIRN

Figure 68

> huIL10.98 (C12A/N45D/C108A/C172A/N205D/C268A/N320A) (SEQ ID NO: 471)

SPGQGTQSENSATHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRALRFLPCENKSKAVEQVKNAFNKLQEKGIYKAMSEFDIFINYIEAYM
TMKIRNSPGQGTQSENSATHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRALRFLPCENKSKAVEQVKNAFNKLQEKGIYKAMSEFDIFIN
YIEAYMTMKIRA

Figure 69

>XENP28903 empty-huIL10.98_huIL10.98_(G4S)2-Fc(216)_IgG1_pI(-
)_Isosteric_A_C220S/PVA_/S267K/L368D/K370S-Fc(216)_IgG1_C220S/PVA_/S267K/S364K/E357Q Chain 1 - empty_Fc(216)_pI(-)_Isosteric_A_C220S/PVA_/S267K/L368D/K370S (SEQ ID NO: 472)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10.98_huIL10.98_(G4S)2_Fc(216)_IgG1_C220S/PVA_/S267K/S364K/E357Q (SEQ ID NO: 473)
*SPGQGTQSENSATHFPGNLPNMLRDLRDAFSRVKTFFQMKDQLDDLLLKESLLEDFKGYLGCQALSEMIQFYLEEVM*
*PQAENQDPDIKAHVNSLGENLKTLRLRLRRALRFLPCENKSKAVEQVKNAFNKLQEKGIYKAMSEFDIFINYIEAYM*
*TMKIRNSPGQGTQSENSATHFPGNLPNMLRDLRDAFSRVKTFFQMKDQLDDLLLKESLLEDFKGYLGCQALSEMIQF*
*YLEEVMPQAENQDPDIKAHVNSLGENLKTLRLRLRRALRFLPCENKSKAVEQVKNAFNKLQEKGIYKAMSEFDIFIN*
*YIEAYMTMKIRA*\GGGGSGGGGS\EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Figure 70A

>huIL10M1(C12A/C108A) (SEQ ID NO: 474)
SPGQGTQSENSATHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRAHRFLPCENGGSGGKSKAVEQVKNAFNKLQEKGIYKAMSEFDIFIN
YIEAYMTMKIRN

>huIL10M1(F37C/M140C) (SEQ ID NO: 475)
SPGQGTQSENSCTHFPGNLPNMLRDLRDAFSRVKTFCQMKDQLDNLLLKESLLEDFKGYLGCQALSEMIQFYLEEVM
PQAENQDPDIKAHVNSLGENLKTLRLRLRRCHRFLPCENGGSGGKSKAVEQVKNAFNKLQEKGIYKACSEFDIFIN
YIEAYMTMKIRN

>huIL10M1(Q38C/S141C) (SEQ ID NO: 476)
SPGQGTQSENSCTHFPGNLPNMLRDLRDAFSRVKTFFCMKDQLDNLLLKESLLEDFKGYLGCQALSEMIQFYLEEVM
PQAENQDPDIKAHVNSLGENLKTLRLRLRRCHRFLPCENGGSGGKSKAVEQVKNAFNKLQEKGIYKAMCEFDIFIN
YIEAYMTMKIRN

>huIL10M1(D41C/K138C) (SEQ ID NO: 477)
SPGQGTQSENSCTHFPGNLPNMLRDLRDAFSRVKTFFQMKCQLDNLLLKESLLEDFKGYLGCQALSEMIQFYLEEVM
PQAENQDPDIKAHVNSLGENLKTLRLRLRRCHRFLPCENGGSGGKSKAVEQVKNAFNKLQEKGIYCAMSEFDIFIN
YIEAYMTMKIRN

>huIL10M1(L47C/K138C) (SEQ ID NO: 478)
SPGQGTQSENSCTHFPGNLPNMLRDLRDAFSRVKTFFQMKDQLDNLCLKESLLEDFKGYLGCQALSEMIQFYLEEVM
PQAENQDPDIKAHVNSLGENLKTLRLRLRRCHRFLPCENGGSGGKSKAVEQVKNAFNKLQEKGIYCAMSEFDIFIN
YIEAYMTMKIRN

>huIL10M1(L48C/E142C) (SEQ ID NO: 479)
SPGQGTQSENSCTHFPGNLPNMLRDLRDAFSRVKTFFQMKDQLDNLLCKESLLEDFKGYLGCQALSEMIQFYLEEVM
PQAENQDPDIKAHVNSLGENLKTLRLRLRRCHRFLPCENGGSGGKSKAVEQVKNAFNKLQEKGIYKAMSCFDIFIN
YIEAYMTMKIRN

>huIL10M1(S51C/A120C) (SEQ ID NO: 480)
SPGQGTQSENSCTHFPGNLPNMLRDLRDAFSRVKTFFQMKDQLDNLLLKECLLEDFKGYLGCQALSEMIQFYLEEVM
PQAENQDPDIKAHVNSLGENLKTLRLRLRRCHRFLPCENGGSGGKSKCVEQVKNAFNKLQEKGIYKAMSEFDIFIN
YIEAYMTMKIRN

>huIL10M1(D55C/A120C) (SEQ ID NO: 481)
SPGQGTQSENSCTHFPGNLPNMLRDLRDAFSRVKTFFQMKDQLDNLLLKESLLECFKGYLGCQALSEMIQFYLEEVM
PQAENQDPDIKAHVNSLGENLKTLRLRLRRCHRFLPCENGGSGGKSKCVEQVKNAFNKLQEKGIYKAMSEFDIFIN
YIEAYMTMKIRN

>huIL10M1(F56C/Y153C) (SEQ ID NO: 482)
SPGQGTQSENSCTHFPGNLPNMLRDLRDAFSRVKTFFQMKDQLDNLLLKESLLEDCKGYLGCQALSEMIQFYLEEVM
PQAENQDPDIKAHVNSLGENLKTLRLRLRRCHRFLPCENGGSGGKSKAVEQVKNAFNKLQEKGIYKAMSEFDIFIN
YIEACMTMKIRN

Figure 70B

>huIL10M1(C62A/C114A) (SEQ ID NO: 483)
SPGQGTQSENSCTHFPGNLPNMLRDLRDAFSRVKTFFQMKDQLDNLLLKESLLEDFKGYLGAQALSEMIQFYLEEVM
PQAENQDPDIKAHVNSLGENLKTLRLRLRRCHRFLPAENGGGSGGKSKAVEQVKNAFNKLQEKGIYKAMSEFDIFIN
YIEAYMTMKIRN

>huIL10M1(A64C/S118C) (SEQ ID NO: 484)
SPGQGTQSENSCTHFPGNLPNMLRDLRDAFSRVKTFFQMKDQLDNLLLKESLLEDFKGYLGCQCLSEMIQFYLEEVM
PQAENQDPDIKAHVNSLGENLKTLRLRLRRCHRFLPCENGGGSGGKCKAVEQVKNAFNKLQEKGIYKAMSEFDIFIN
YIEAYMTMKIRN

>huIL10M1(M68C/V121C) (SEQ ID NO: 485)
SPGQGTQSENSCTHFPGNLPNMLRDLRDAFSRVKTFFQMKDQLDNLLLKESLLEDFKGYLGCQALSCMIQFYLEEVM
PQAENQDPDIKAHVNSLGENLKTLRLRLRRCHRFLPCENGGGSGGKSKACEQVKNAFNKLQEKGIYKAMSEFDIFIN
YIEAYMTMKIRN

>huIL10M1(V76C/A139C) (SEQ ID NO: 486)
SPGQGTQSENSCTHFPGNLPNMLRDLRDAFSRVKTFFQMKDQLDNLLLKESLLEDFKGYLGCQALSEMIQFYLEECM
PQAENQDPDIKAHVNSLGENLKTLRLRLRRCHRFLPCENGGGSGGKSKAVEQVKNAFNKLQEKGIYKCMSEFDIFIN
YIEAYMTMKIRN

Figure 71A

>XENP25740 empty-Fc(216)-huIL10M1.1_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 487)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.1_Fc(216)_IgG1_C220S/S364K/E357Q (SEQ ID NO: 488)
*SPGQGTQSENSATHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRAHRFLPCENGGSGGKSKAVEQVKNAFNKLQEKGIYKAMSEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

>XENP25741 empty-Fc(216)-huIL10M1.2_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 489)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.2_Fc(216)_IgG1_C220S/S364K/E357Q (SEQ ID NO: 490)
*SPGQGTQSENSCTHFPGNLPNMLRDLRDAFSRVKTFCQMKDQLDNLLLKESLLEDFKGYLGCQALSEMIQFYLEEVM
PQAENQDPDIKAHVNSLGENLKTLRLRLRRCHRFLPCENGGSGGKSKAVEQVKNAFNKLQEKGIYKACSEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

>XENP25742 empty-Fc(216)-huIL10M1.3_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 491)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.3_Fc(216)_IgG1_C220S/S364K/E357Q (SEQ ID NO: 492)
*SPGQGTQSENSCTHFPGNLPNMLRDLRDAFSRVKTFFCMKDQLDNLLLKESLLEDFKGYLGCQALSEMIQFYLEEVM
PQAENQDPDIKAHVNSLGENLKTLRLRLRRCHRFLPCENGGSGGKSKAVEQVKNAFNKLQEKGIYKAMCEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 71B

>XENP25743 empty-Fc(216)-huIL10M1.4_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 493)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.4_Fc(216)_IgG1_C220S/S364K/E357Q (SEQ ID NO: 494)
*SPGQGTQSENSCTHFPGNLPNMLRDLRDAFSRVKTFFQMKCQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYCAMSEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

>XENP25744 empty-Fc(216)-huIL10M1.5_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 495)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.5_Fc(216)_IgG1_C220S/S364K/E357Q (SEQ ID NO: 496)
*SPGQGTQSENSCTHFPGNLPNMLRDLRDAFSRVKTFFQMKDQLDNLCLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYCAMSEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

>XENP25745 empty-Fc(216)-huIL10M1.6_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 497)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.6_Fc(216)_IgG1_C220S/S364K/E357Q (SEQ ID NO: 498)
*SPGQGTQSENSCTHFPGNLPNMLRDLRDAFSRVKTFFQMKDQLDNLLCKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSCFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 71C

>XENP25746 empty-Fc(216)-huIL10M1.7_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 499)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.7_Fc(216)_IgG1_C220S/S364K/E357Q (SEQ ID NO: 500)
*SPGQGTQSENSCTHFPGNLPNMLRDLRDAFSRVKTFFQMKDQLDNLLLKECLLEDFKGYLGCQALSEMIQFYLEEVM
PQAENQDPDIKAHVNSLGENLKTLRLRLRRCHRFLPCENGGGSGGKSKCVEQVKNAFNKLQEKGIYKAMSEFDIFIN
YIEAYMTMKIRN/*EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

>XENP25747 empty-Fc(216)-huIL10M1.8_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 501)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.8_Fc(216)_IgG1_C220S/S364K/E357Q (SEQ ID NO: 502)
*SPGQGTQSENSCTHFPGNLPNMLRDLRDAFSRVKTFFQMKDQLDNLLLKESLLECFKGYLGCQALSEMIQFYLEEVM
PQAENQDPDIKAHVNSLGENLKTLRLRLRRCHRFLPCENGGGSGGKSKCVEQVKNAFNKLQEKGIYKAMSEFDIFIN
YIEAYMTMKIRN/*EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

>XENP25748 empty-Fc(216)-huIL10M1.9_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 503)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.9_Fc(216)_IgG1_C220S/S364K/E357Q (SEQ ID NO: 504)
*SPGQGTQSENSCTHFPGNLPNMLRDLRDAFSRVKTFFQMKDQLDNLLLKESLLEDCKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEACMTMKIRN/*EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 71D

>XENP25749 empty-Fc(216)-huIL10M1.10_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 505)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.10_Fc(216)_IgG1_C220S/S364K/E357Q (SEQ ID NO: 506)
*SPGQGTQSENSCTHFPGNLPNMLRDLRDAFSRVKTFFQMKDQLDNLLLKESLLEDFKGYLGAQALSEMIQFYLEEVM*
*PQAENQDPDIKAHVNSLGENLKTLRLRLRRCHRFLPAENGGGSGGKSKAVEQVKNAFNKLQEKGIYKAMSEFDIFIN*
*YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

>XENP25750 empty-Fc(216)-huIL10M1.11_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 507)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.11_Fc(216)_IgG1_C220S/S364K/E357Q (SEQ ID NO: 508)
*SPGQGTQSENSCTHFPGNLPNMLRDLRDAFSRVKTFFQMKDQLDNLLLKESLLEDFKGYLGCQCLSEMIQFYLEEVM*
*PQAENQDPDIKAHVNSLGENLKTLRLRLRRCHRFLPCENGGGSGGKCKAVEQVKNAFNKLQEKGIYKAMSEFDIFIN*
*YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

>XENP25751 empty-Fc(216)-huIL10M1.12_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 509)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.12_Fc(216)_IgG1_C220S/S364K/E357Q (SEQ ID NO: 510)
*SPGQGTQSENSCTHFPGNLPNMLRDLRDAFSRVKTFFQMKDQLDNLLLKESLLEDFKGYLGCQALSCMIQFYLEEVM*
*PQAENQDPDIKAHVNSLGENLKTLRLRLRRCHRFLPCENGGGSGGKSKACEQVKNAFNKLQEKGIYKAMSEFDIFIN*
*YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 71E

>XENP25752 empty-Fc(216)-huIL10M1.13_Fc(216)_IgG1_PVA_/S267K_pI(-)_Isosteric_A_L368D/K370S-IgG1_C220S/S364K/E357Q Chain 1 - empty_Fc(216)_IgG1_PVA_/S267K_pI(-)_Isosteric_A_L368D/K370S (SEQ ID NO: 511)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10M1.13_Fc(216)_IgG1_C220S/S364K/E357Q (SEQ ID NO: 512)
SPGQGTQSENSCTHFPGNLPNMLRDLRDAFSRVKTFFQMKDQLDNLLLKESLLEDFKGYLGCQALSEMIQFYLEECM
PQAENQDPDIKAHVNSLGENLKTLRLRLRRCHRFLPCENGGGSGGKSKAVEQVKNAFNKLQEKGIYKCMSEFDIFIN
YIEAYMTMKIRN/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 72A

| WT | pos | mut | Affinity | dAffinity | Stability | dStability |
|----|-----|-----|----------|-----------|-----------|------------|
| L  | 19  | F   | -465.64145 | -2.9224278 | -1136.985 | 1.0106542 |
| L  | 19  | Y   | -465.66832 | -2.9492962 | -1136.9831 | 1.0126197 |
| L  | 19  | W   | -466.65686 | -3.9378369 | -1136.9718 | 1.0238889 |

Figure 72B

| WT | pos | mut | Affinity | dAffinity | Stability | dStability |
|----|-----|-----|----------|-----------|-----------|------------|
| L  | 23  | I   | -459.01758 | -0.7521349 | -1136.2733 | 1.1945555 |
| L  | 23  | M   | -460.7965  | -2.5310585 | -1136.0156 | 1.4522318 |
| L  | 23  | K   | -459.63816 | -1.3727147 | -1135.8626 | 1.6052346 |
| L  | 23  | Y   | -458.99702 | -0.7315728 | -1135.505  | 1.9628586 |
| L  | 23  | V   | -457.06321 | 1.2022357  | -1135.4721 | 1.9957179 |
| L  | 23  | Q   | -456.84071 | 1.4247344  | -1135.4646 | 2.0032668 |
| L  | 23  | W   | -458.73945 | -0.4740034 | -1135.36   | 2.1078219 |
| L  | 23  | H   | -455.82001 | 2.4454377  | -1135.3018 | 2.1659987 |
| L  | 23  | R   | -459.13846 | -0.8730173 | -1135.2062 | 2.2616562 |
| L  | 23  | N   | -455.69675 | 2.5686997  | -1135.1365 | 2.3313085 |
| L  | 23  | F   | -458.69149 | -0.4260419 | -1134.9215 | 2.5463257 |
| L  | 23  | E   | -458.44991 | -0.1844599 | -1134.8357 | 2.6320873 |
| L  | 23  | T   | -455.54594 | 2.7195005  | -1134.7856 | 2.682217  |
| L  | 23  | D   | -454.93757 | 3.3278708  | -1133.9618 | 3.5060541 |

Figure 72C

| WT | pos | mut | Affinity | dAffinity | Stability | dStability |
|----|-----|-----|----------|-----------|-----------|------------|
| L  | 26  | Q   | -458.65475 | 0.9302625 | -1135.3484 | 1.7950256 |
| L  | 26  | E   | -459.12757 | 0.4574448 | -1135.0338 | 2.1096833 |
| L  | 26  | N   | -457.92968 | 1.6553373 | -1134.6646 | 2.4788575 |
| L  | 26  | S   | -456.0913  | 3.4937109 | -1134.635  | 2.5084727 |
| L  | 26  | D   | -455.34196 | 4.2430491 | -1134.4289 | 2.7145327 |

Figure 72D

| WT | pos | mut | Affinity | dAffinity | Stability | dStability |
|----|-----|-----|----------|-----------|-----------|------------|
| A  | 29  | S   | -459.46594 | -1.1322596 | -1136.2874 | 0.7202889 |
| A  | 29  | G   | -458.44799 | -0.1143085 | -1135.5334 | 1.4743089 |

Figure 72E

| WT | pos | mut | Affinity | dAffinity | Stability | dStability |
|---|---|---|---|---|---|---|
| F | 30 | Y | -462.58987 | -1.7275466 | -1138.6677 | 0.6059102 |
| F | 30 | M | -460.54096 | 0.3213586 | -1138.1928 | 1.0807642 |
| F | 30 | H | -459.15821 | 1.704106 | -1136.9774 | 2.2962605 |

Figure 72F

| WT | pos | mut | Affinity | dAffinity | Stability | dStability |
|---|---|---|---|---|---|---|
| V | 33 | I | -461.74932 | 0.2802391 | -1136.5261 | 0.2921138 |
| V | 33 | T | -461.82451 | 0.2050445 | -1135.4988 | 1.3194702 |
| V | 33 | N | -463.0455 | -1.0159405 | -1135.3001 | 1.518124 |
| V | 33 | D | -461.58762 | 0.4419306 | -1134.9214 | 1.8968377 |
| V | 33 | S | -462.3209 | -0.2913454 | -1134.8286 | 1.9896196 |

Figure 72G

| WT | pos | mut | Affinity | dAffinity | Stability | dStability |
|---|---|---|---|---|---|---|
| F | 37 | W | -462.20221 | 0.8488002 | -1138.2419 | 1.2421108 |
| F | 37 | R | -461.62505 | 1.425956 | -1137.4121 | 2.0718771 |
| F | 37 | M | -458.73275 | 4.3182562 | -1137.209 | 2.2749835 |
| F | 37 | K | -460.18505 | 2.8659599 | -1136.9606 | 2.5233939 |
| F | 37 | Q | -460.67524 | 2.3757663 | -1136.7051 | 2.7789211 |
| F | 37 | H | -458.89323 | 4.1577753 | -1136.6086 | 2.8754068 |
| F | 37 | D | -456.35334 | 6.6976678 | -1135.8893 | 3.5946766 |
| F | 37 | N | -456.63471 | 6.4162933 | -1135.8204 | 3.6635864 |

Figure 72H

| WT | pos | mut | Affinity | dAffinity | Stability | dStability |
|---|---|---|---|---|---|---|
| L | 47 | M | -460.52442 | -4.0291981 | -1136.8597 | 0.619539 |
| L | 47 | Q | -460.91531 | -4.4200922 | -1136.2371 | 1.2422162 |
| L | 47 | E | -456.50543 | -0.0102163 | -1135.5493 | 1.9300084 |
| L | 47 | N | -453.16215 | 3.3330715 | -1135.169 | 2.3102992 |
| L | 47 | D | -450.7784 | 5.7168139 | -1134.4009 | 3.0783405 |

Figure 72I

| WT | pos | mut | Affinity | dAffinity | Stability | dStability |
|---|---|---|---|---|---|---|
| L | 48 | M | -462.15491 | 0.860486 | -1136.8368 | 1.3685249 |
| L | 48 | Q | -461.03187 | 1.9835337 | -1136.1922 | 2.0130513 |
| L | 48 | E | -461.58162 | 1.4337796 | -1136.1473 | 2.057985 |
| L | 48 | N | -459.7357 | 3.2796994 | -1135.9308 | 2.2744498 |

Figure 72J

| WT | pos | mut | Affinity | dAffinity | Stability | dStability |
|----|-----|-----|----------|-----------|-----------|------------|
| L | 52 | M | -464.82422 | -0.056424 | -1136.1529 | 1.5857674 |
| L | 52 | Q | -466.65336 | -1.8855612 | -1135.6947 | 2.0439849 |
| L | 52 | E | -464.03426 | 0.7335339 | -1135.5935 | 2.145136 |
| L | 52 | T | -463.30404 | 1.4637585 | -1135.5599 | 2.1787885 |
| L | 52 | N | -462.84355 | 1.9242426 | -1135.2638 | 2.4748357 |
| L | 52 | D | -464.33432 | 0.4334744 | -1134.7813 | 2.9573274 |

Figure 72K

| WT | pos | mut | Affinity | dAffinity | Stability | dStability |
|----|-----|-----|----------|-----------|-----------|------------|
| F | 56 | K | -461.39703 | 1.9838693 | -1136.6299 | 2.3933172 |
| F | 56 | H | -461.61977 | 1.7611309 | -1136.4875 | 2.5357247 |
| F | 56 | N | -461.39529 | 1.9856112 | -1136.2705 | 2.7527437 |

Figure 72L

| WT | pos | mut | Affinity | dAffinity | Stability | dStability |
|----|-----|-----|----------|-----------|-----------|------------|
| A | 64 | S | -462.91026 | 0.2457443 | -1137.1384 | 0.7597952 |

Figure 72M

| WT | pos | mut | Affinity | dAffinity | Stability | dStability |
|----|-----|-----|----------|-----------|-----------|------------|
| L | 65 | M | -464.93978 | -0.8628063 | -1136.85 | 1.1027188 |
| L | 65 | V | -463.08995 | 0.9870151 | -1136.6817 | 1.2709947 |
| L | 65 | Q | -464.21547 | -0.1384963 | -1136.1365 | 1.8161976 |
| L | 65 | T | -463.92224 | 0.15473 | -1136.0708 | 1.8819263 |
| L | 65 | N | -464.38621 | -0.3092406 | -1135.8374 | 2.1153249 |
| L | 65 | E | -464.66616 | -0.5891959 | -1135.757 | 2.1957387 |
| L | 65 | S | -462.57277 | 1.5041941 | -1135.4139 | 2.5388455 |
| L | 65 | D | -464.96485 | -0.8878843 | -1135.3579 | 2.5948505 |

Figure 72N

| WT | pos | mut | Affinity | dAffinity | Stability | dStability |
|----|-----|-----|----------|-----------|-----------|------------|
| S | 66 | W | -460.58575 | 2.4523206 | -1135.8574 | 0.2716062 |
| S | 66 | F | -460.44103 | 2.597038 | -1135.8219 | 0.3071048 |
| S | 66 | Y | -460.56734 | 2.4707301 | -1135.7549 | 0.3741404 |
| S | 66 | M | -460.2935 | 2.7445758 | -1135.6101 | 0.5189019 |
| S | 66 | Q | -459.96009 | 3.0779834 | -1135.4265 | 0.7025135 |
| S | 66 | N | -460.9241 | 2.113972 | -1135.1929 | 0.936165 |
| S | 66 | E | -462.94795 | 0.090119 | -1135.0183 | 1.1106973 |
| S | 66 | H | -461.38468 | 1.653395 | -1134.9686 | 1.1604261 |

Figure 72O

| WT | pos | mut | Affinity | dAffinity | Stability | dStability |
|---|---|---|---|---|---|---|
| M | 68 | Q | -461.43999 | -0.818485 | -1137.5569 | 1.1520752 |
| M | 68 | T | -458.7061 | 1.9154039 | -1137.4268 | 1.2822038 |
| M | 68 | E | -461.4337 | -0.812197 | -1136.8425 | 1.8665438 |
| M | 68 | N | -458.58146 | 2.0400458 | -1136.7838 | 1.9251963 |
| M | 68 | S | -457.69727 | 2.9242332 | -1136.7173 | 1.9916945 |

Figure 72P

| WT | pos | mut | Affinity | dAffinity | Stability | dStability |
|---|---|---|---|---|---|---|
| I | 69 | L | -464.14535 | -1.2424714 | -1138.0577 | 0.7455505 |
| I | 69 | R | -464.29141 | -1.3885243 | -1138.0198 | 0.7834823 |
| I | 69 | M | -464.30545 | -1.4025703 | -1137.8041 | 0.9991058 |
| I | 69 | K | -464.25088 | -1.3479952 | -1137.2253 | 1.5779416 |
| I | 69 | E | -463.48879 | -0.5859122 | -1136.7937 | 2.0095666 |
| I | 69 | Q | -463.31543 | -0.4125462 | -1136.5014 | 2.301818 |
| I | 69 | N | -462.66585 | 0.2370342 | -1136.0631 | 2.7401783 |
| I | 69 | D | -463.93285 | -1.0299683 | -1135.8251 | 2.9781953 |

Figure 72Q

| WT | pos | mut | Affinity | dAffinity | Stability | dStability |
|---|---|---|---|---|---|---|
| F | 71 | W | -459.91555 | 1.3706198 | -1138.3722 | 1.3858862 |
| F | 71 | Y | -461.00716 | 0.2790094 | -1138.1415 | 1.6165941 |
| F | 71 | R | -463.15087 | -1.8647015 | -1138.0157 | 1.742431 |
| F | 71 | L | -457.88279 | 3.403384 | -1137.774 | 1.9841046 |
| F | 71 | M | -459.91267 | 1.3734986 | -1137.246 | 2.5120758 |
| F | 71 | K | -459.71664 | 1.5695267 | -1137.1925 | 2.5656131 |
| F | 71 | Q | -458.95459 | 2.3315806 | -1136.9415 | 2.8166148 |
| F | 71 | N | -455.71494 | 5.5712289 | -1136.478 | 3.2801304 |
| F | 71 | H | -458.95994 | 2.326229 | -1136.4373 | 3.3208011 |
| F | 71 | E | -457.28853 | 3.9976395 | -1136.4233 | 3.3348161 |
| F | 71 | D | -455.28377 | 6.0023959 | -1135.9368 | 3.821272 |

Figure 72R

| WT | pos | mut | Affinity | dAffinity | Stability | dStability |
|---|---|---|---|---|---|---|
| Y | 72 | M | -458.1877 | 1.9791757 | -1135.7051 | 1.5240714 |
| Y | 72 | Q | -458.73773 | 1.4291401 | -1135.1654 | 2.0637441 |
| Y | 72 | K | -458.84345 | 1.3234229 | -1134.9732 | 2.2559382 |
| Y | 72 | H | -458.24949 | 1.9173773 | -1134.7646 | 2.4645507 |
| Y | 72 | E | -455.88201 | 4.2848612 | -1134.6334 | 2.5957436 |

Figure 72S

| WT | pos | mut | Affinity | dAffinity | Stability | dStability |
|---|---|---|---|---|---|---|
| V | 76 | T | -462.6827 | -0.1209692 | -1136.4804 | 1.4556246 |
| V | 76 | N | -462.10601 | 0.4557156 | -1136.0551 | 1.8809754 |
| V | 76 | S | -461.8705 | 0.6912321 | -1135.8282 | 2.1078816 |
| V | 76 | D | -460.3814 | 2.1803312 | -1135.7523 | 2.1837514 |

Figure 72T

| WT | pos | mut | Affinity | dAffinity | Stability | dStability |
|---|---|---|---|---|---|---|
| M | 77 | Q | -461.13916 | -0.33941 | -1137.4667 | 1.2832958 |
| M | 77 | K | -461.41683 | -0.6170843 | -1137.2506 | 1.4993703 |
| M | 77 | H | -459.0288 | 1.7709537 | -1137.172 | 1.5779393 |

Figure 72U

| WT | pos | mut | Affinity | dAffinity | Stability | dStability |
|---|---|---|---|---|---|---|
| A | 80 | S | -463.2227 | -1.2218906 | -1137.4166 | 0.8865687 |
| A | 80 | G | -460.92762 | 1.0731846 | -1136.4134 | 1.8897549 |

Figure 72V

| WT | pos | mut | Affinity | dAffinity | Stability | dStability |
|---|---|---|---|---|---|---|
| E | 81 | K | -464.44752 | -0.5340727 | -1132.4702 | 0.3352634 |
| E | 81 | R | -464.08379 | -0.1703464 | -1132.3104 | 0.4950689 |
| E | 81 | M | -463.92664 | -0.0131987 | -1132.2044 | 0.6011172 |
| E | 81 | A | -464.21907 | -0.3056229 | -1131.8787 | 0.9267576 |
| E | 81 | S | -463.95222 | -0.0387753 | -1131.6477 | 1.1577354 |

Figure 72W

| WT | pos | mut | Affinity | dAffinity | Stability | dStability |
|---|---|---|---|---|---|---|
| I | 87 | V | -461.71324 | -0.2119055 | -1138.407 | 1.1973042 |
| I | 87 | R | -461.25083 | 0.2505043 | -1138.0504 | 1.5538621 |
| I | 87 | F | -461.63281 | -0.1314742 | -1137.9154 | 1.6889359 |
| I | 87 | Q | -461.24755 | 0.2537855 | -1137.912 | 1.6922797 |
| I | 87 | T | -461.08838 | 0.4129554 | -1137.8283 | 1.7760094 |
| I | 87 | K | -461.19366 | 0.307683 | -1137.7764 | 1.8278856 |
| I | 87 | M | -461.54247 | -0.0411351 | -1137.6912 | 1.9131398 |
| I | 87 | Y | -461.88806 | -0.3867243 | -1137.5856 | 2.0187308 |
| I | 87 | E | -461.29266 | 0.2086778 | -1137.2277 | 2.3765915 |
| I | 87 | H | -461.72465 | -0.2233147 | -1136.6635 | 2.9408127 |
| I | 87 | N | -461.91338 | -0.4120377 | -1136.6468 | 2.957526 |
| I | 87 | D | -461.80288 | -0.3015366 | -1136.3501 | 3.2541695 |

Figure 72X

| WT | pos | mut | Affinity | dAffinity | Stability | dStability |
|---|---|---|---|---|---|---|
| V | 91 | S | -461.99207 | 0.4679272 | -1136.2426 | 2.0660342 |
| V | 91 | A | -461.38217 | 1.0778211 | -1136.0916 | 2.2170556 |
| V | 91 | G | -460.90722 | 1.5527733 | -1135.2898 | 3.0188922 |

Figure 72Y

| WT | pos | mut | Affinity | dAffinity | Stability | dStability |
|---|---|---|---|---|---|---|
| L | 94 | M | -462.61399 | 0.4562435 | -1136.8344 | 1.2702765 |
| L | 94 | T | -461.49734 | 1.5728929 | -1136.1798 | 1.9248778 |
| L | 94 | N | -461.704 | 1.3662306 | -1135.6264 | 2.4783595 |
| L | 94 | D | -461.06429 | 2.0059384 | -1135.6176 | 2.4871299 |

Figure 72Z

| WT | pos | mut | Affinity | dAffinity | Stability | dStability |
|---|---|---|---|---|---|---|
| G | 95 | R | -463.19138 | -0.1314203 | -1138.772 | -1.5026127 |
| G | 95 | F | -463.25691 | -0.1969458 | -1138.1993 | -0.9298901 |
| G | 95 | Y | -462.7906 | 0.2693681 | -1138.1341 | -0.8647562 |
| G | 95 | M | -463.21666 | -0.1566933 | -1138.0367 | -0.7672909 |
| G | 95 | N | -463.32772 | -0.2677536 | -1137.8097 | -0.5403643 |
| G | 95 | Q | -463.21208 | -0.1521213 | -1137.8037 | -0.5342761 |
| G | 95 | A | -463.13441 | -0.0744419 | -1137.5587 | -0.2893293 |
| G | 95 | S | -463.26276 | -0.2027967 | -1137.4306 | -0.1611701 |
| G | 95 | E | -462.86833 | 0.1916293 | -1137.0332 | 0.2361526 |

Figure 72AA

| WT | pos | mut | Affinity | dAffinity | Stability | dStability |
|---|---|---|---|---|---|---|
| L | 98 | M | -462.34741 | 0.9062235 | -1136.388 | 1.3760324 |
| L | 98 | T | -460.66731 | 2.5863236 | -1135.552 | 2.212005 |
| L | 98 | Q | -461.54452 | 1.7091081 | -1135.5412 | 2.2227638 |
| L | 98 | N | -461.93405 | 1.3195814 | -1135.3876 | 2.3763561 |
| L | 98 | E | -461.117 | 2.1366289 | -1135.3795 | 2.3844562 |
| L | 98 | D | -462.19852 | 1.0551167 | -1134.9846 | 2.7794104 |

Figure 72AB

| WT | pos | mut | Affinity | dAffinity | Stability | dStability |
|---|---|---|---|---|---|---|
| L | 101 | M | -463.4077 | 0.0974904 | -1136.9164 | 1.2852374 |
| L | 101 | T | -462.08852 | 1.4166688 | -1136.219 | 1.9826802 |
| L | 101 | Q | -463.68536 | -0.180167 | -1136.1521 | 2.0495137 |
| L | 101 | E | -463.17488 | 0.3303132 | -1136.0246 | 2.1770227 |
| L | 101 | H | -463.41263 | 0.0925592 | -1135.7541 | 2.4475239 |
| L | 101 | N | -462.02685 | 1.4783415 | -1135.4975 | 2.704128 |
| L | 101 | D | -462.12459 | 1.3805994 | -1135.1343 | 3.0673335 |

Figure 72AC

| WT | pos | mut | Affinity | dAffinity | Stability | dStability |
|---|---|---|---|---|---|---|
| L | 105 | R | -464.2482 | -2.1856938 | -1136.282 | 1.062361 |
| L | 105 | M | -463.94105 | -1.8785401 | -1136.0046 | 1.3396805 |
| L | 105 | Q | -464.69227 | -2.6297627 | -1135.4297 | 1.9145893 |
| L | 105 | K | -463.91057 | -1.8480592 | -1135.4223 | 1.9220245 |
| L | 105 | E | -463.19031 | -1.1277992 | -1135.1383 | 2.2060306 |
| L | 105 | N | -463.76276 | -1.7002513 | -1135.0558 | 2.2884701 |
| L | 105 | D | -462.54425 | -0.481744 | -1134.6985 | 2.645767 |

Figure 72AD

| WT | pos | mut | Affinity | dAffinity | Stability | dStability |
|---|---|---|---|---|---|---|
| L | 112 | M | -460.60587 | 1.2154475 | -1135.8742 | 1.3560119 |
| L | 112 | Q | -460.60888 | 1.2124327 | -1135.1613 | 2.0688602 |
| L | 112 | E | -462.45519 | -0.6338677 | -1135.1546 | 2.0755593 |
| L | 112 | N | -460.98485 | 0.836466 | -1134.6146 | 2.6156282 |

Figure 72AE

| WT | pos | mut | Affinity | dAffinity | Stability | dStability |
|---|---|---|---|---|---|---|
| S | 118 | A | -463.59924 | -0.6165556 | -1136.1332 | 0.9021512 |
| S | 118 | G | -463.33982 | -0.3571409 | -1135.3874 | 1.6479792 |

Figure 72AF

| WT | pos | mut | Affinity | dAffinity | Stability | dStability |
|---|---|---|---|---|---|---|
| V | 121 | W | -463.53635 | -1.9829366 | -1136.5528 | 0.9528845 |
| V | 121 | R | -458.81481 | 2.7386086 | -1136.4885 | 1.0172248 |
| V | 121 | Q | -461.49127 | 0.0621396 | -1136.4103 | 1.0953955 |
| V | 121 | M | -460.26366 | 1.2897578 | -1136.3435 | 1.1622158 |
| V | 121 | N | -457.90398 | 3.6494346 | -1135.7427 | 1.7629967 |
| V | 121 | H | -458.14133 | 3.412089 | -1135.5457 | 1.9600001 |
| V | 121 | D | -458.40757 | 3.1458438 | -1135.0823 | 2.4233674 |

Figure 72AG

| WT | pos | mut | Affinity | dAffinity | Stability | dStability |
|---|---|---|---|---|---|---|
| V | 124 | M | -464.16684 | -1.6848117 | -1136.5459 | 1.0174543 |
| V | 124 | Q | -464.41173 | -1.9297019 | -1135.9665 | 1.5969097 |
| V | 124 | N | -464.82502 | -2.3429936 | -1135.8806 | 1.6828174 |
| V | 124 | E | -465.02619 | -2.5441655 | -1135.7509 | 1.8125129 |
| V | 124 | H | -464.83197 | -2.3499423 | -1135.5654 | 1.9979673 |
| V | 124 | D | -462.28871 | 0.193312 | -1134.7752 | 2.7882005 |

Figure 72AH

| WT | pos | mut | Affinity | dAffinity | Stability | dStability |
|----|-----|-----|----------|-----------|-----------|------------|
| F | 128 | W | -464.63776 | -2.8221404 | -1138.5493 | 0.9233753 |
| F | 128 | Y | -459.58269 | 2.2329305 | -1138.2832 | 1.1894774 |
| F | 128 | R | -461.57697 | 0.2386443 | -1138.1935 | 1.2791912 |
| F | 128 | M | -460.63956 | 1.1760557 | -1138.0992 | 1.373434 |
| F | 128 | H | -459.97727 | 1.8383529 | -1137.3811 | 2.0915344 |

Figure 72AI

| WT | pos | mut | Affinity | dAffinity | Stability | dStability |
|----|-----|-----|----------|-----------|-----------|------------|
| K | 138 | Q | -461.18358 | -1.0015889 | -1134.7018 | 1.4973046 |
| K | 138 | E | -455.05816 | 5.1238263 | -1133.8392 | 2.3599883 |
| K | 138 | N | -455.08967 | 5.0923208 | -1133.8147 | 2.3844919 |
| K | 138 | S | -454.7683 | 5.4136921 | -1133.7877 | 2.4114501 |
| K | 138 | D | -454.64213 | 5.539859 | -1133.0058 | 3.1933275 |

Figure 72AJ

| WT | pos | mut | Affinity | dAffinity | Stability | dStability |
|----|-----|-----|----------|-----------|-----------|------------|
| A | 139 | L | -462.08192 | -0.2230337 | -1138.4702 | -0.0985639 |
| A | 139 | M | -461.31247 | 0.5464113 | -1138.0007 | 0.3709335 |
| A | 139 | Q | -464.32645 | -2.4675693 | -1137.6438 | 0.7278241 |
| A | 139 | E | -461.91661 | -0.057726 | -1137.281 | 1.0905487 |
| A | 139 | D | -460.85695 | 1.0019316 | -1137.1062 | 1.265439 |
| A | 139 | N | -460.38866 | 1.4702205 | -1137.0202 | 1.3514273 |
| A | 139 | S | -457.69074 | 4.1681441 | -1137 | 1.3715431 |

Figure 72AK

| WT | pos | mut | Affinity | dAffinity | Stability | dStability |
|----|-----|-----|----------|-----------|-----------|------------|
| M | 140 | Q | -459.82013 | 0.1759617 | -1137.3166 | 1.4338095 |

Figure 72AL

| WT | pos | mut | Affinity | dAffinity | Stability | dStability |
|----|-----|-----|----------|-----------|-----------|------------|
| S | 141 | A | -461.41765 | 1.3735756 | -1136.5434 | 0.6189105 |

Figure 72AM

| WT | pos | mut | Affinity | dAffinity | Stability | dStability |
|----|-----|-----|----------|-----------|-----------|------------|
| F | 143 | Y | -462.03556 | -3.0965958 | -1138.3821 | 1.2299604 |
| F | 143 | H | -457.97884 | 0.9601211 | -1137.0887 | 2.523371 |
| F | 143 | N | -453.84496 | 5.094 | -1136.595 | 3.0170255 |
| F | 143 | D | -454.12391 | 4.8150486 | -1136.4618 | 3.1502216 |

Figure 72AN

| WT | pos | mut | Affinity | dAffinity | Stability | dStability |
|---|---|---|---|---|---|---|
| F | 146 | Q | -458.49573 | 3.9388701 | -1137.413 | 2.3120238 |
| F | 146 | E | -458.67585 | 3.7587517 | -1137.201 | 2.5240423 |
| F | 146 | H | -459.5923 | 2.8423004 | -1137.0519 | 2.6730898 |
| F | 146 | A | -453.91725 | 8.5173432 | -1136.6784 | 3.0466542 |
| F | 146 | N | -456.4095 | 6.0251014 | -1136.626 | 3.0989923 |
| F | 146 | D | -456.28409 | 6.1505088 | -1136.4855 | 3.2395021 |
| F | 146 | S | -454.29566 | 8.138934 | -1136.4731 | 3.2519514 |

Figure 72AO

| WT | pos | mut | Affinity | dAffinity | Stability | dStability |
|---|---|---|---|---|---|---|
| I | 147 | R | -459.39403 | -1.3723559 | -1137.4496 | 1.0310071 |
| I | 147 | L | -457.74298 | 0.2786946 | -1137.3554 | 1.1251641 |
| I | 147 | M | -456.50687 | 1.5148035 | -1137.0016 | 1.4789521 |
| I | 147 | Y | -455.8818 | 2.1398747 | -1136.887 | 1.5936117 |
| I | 147 | W | -458.66979 | -0.6481163 | -1136.8042 | 1.6763482 |
| I | 147 | Q | -456.51182 | 1.5098557 | -1136.3765 | 2.1041006 |
| I | 147 | T | -454.30622 | 3.7154578 | -1136.3577 | 2.1228637 |
| I | 147 | E | -459.62087 | -1.5991969 | -1136.2923 | 2.1883126 |
| I | 147 | N | -456.60004 | 1.4216386 | -1136.098 | 2.3825726 |
| I | 147 | D | -458.65803 | -0.6363512 | -1135.9322 | 2.5483764 |

Figure 72AP

| WT | pos | mut | Affinity | dAffinity | Stability | dStability |
|---|---|---|---|---|---|---|
| I | 150 | L | -463.63684 | -1.3481494 | -1138.5484 | 0.7931715 |
| I | 150 | M | -465.53796 | -3.2492741 | -1138.4429 | 0.8986043 |
| I | 150 | Q | -465.18174 | -2.8930506 | -1137.9216 | 1.4199104 |
| I | 150 | T | -461.94023 | 0.3484593 | -1137.7157 | 1.6258277 |
| I | 150 | E | -465.18074 | -2.8920564 | -1137.4678 | 1.8737369 |
| I | 150 | N | -462.36189 | -0.0732059 | -1137.2601 | 2.0814525 |
| I | 150 | D | -462.12876 | 0.1599281 | -1136.8431 | 2.4984388 |

Figure 73

>huIL10M1 (L47Q) (SEQ ID NO: 513)
SPGQGTQSENSCTHFPGNLPNMLRDLRDAFSRVKTFFQMKDQLDNLQLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN

>huIL10M1 (S118A) (SEQ ID NO: 514)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKAKAVEQVKNAFNKLQEKGIYKAMSEFDIFIN
YIEAYMTMKIRN

>huIL10M1 (A139Q) (SEQ ID NO: 515)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKQMSEFDIFIN
YIEAYMTMKIRN

Figure 74A

>XENP25762 empty-Fc(216)-huIL10M1.23_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 516)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10M1.23_Fc(216)_IgG1_C220S/S364K/E357Q (SEQ ID NO: 517)
SPGQGTQSENSCTHFPGNLPNMLRDLRDAFSRVKTFFQMKDQLDNLQLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKAMSEFDIFIN
YIEAYMTMKIRN/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 74B

>XENP25764 empty-Fc(216)-huIL10M1.25_Fc(216)_IgG1_PVA_/S267K_pI(-)_Isosteric_A_L368D/K370S-IgG1_C220S/S364K/E357Q Chain 1 - empty_Fc(216)_IgG1_PVA_/S267K_pI(-)_Isosteric_A_L368D/K370S (SEQ ID NO: 518)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10M1.25_Fc(216)_IgG1_C220S/S364K/E357Q (SEQ ID NO: 519)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKAKAVEQVKNAFNKLQEKGIYKAMSEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK >XENP25765 empty-Fc(216)-huIL10M1.26_Fc(216)_IgG1_PVA_/S267K_pI(-)_Isosteric_A_L368D/K370S-IgG1_C220S/S364K/E357Q Chain 1 - empty_Fc(216)_IgG1_PVA_/S267K_pI(-)_Isosteric_A_L368D/K370S (SEQ ID NO: 520)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK Chain 2 - huIL10M1.26_Fc(216)_IgG1_C220S/S364K/E357Q (SEQ ID NO: 521)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGGKSKAVEQVKNAFNKLQEKGIYKQMSEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 75A

>huIL10M1 (WT + PGGSGG Linker (SEQ ID NO: 40)) (SEQ ID NO: 522)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENPGGSGGKSKAVEQVKNAFNKLQEKGIYKAMSEFDIFIN
YIEAYMTMKIRN

>huIL10M1 (WT + GPGSGG Linker (SEQ ID NO: 41)) (SEQ ID NO: 523)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGPGSGGKSKAVEQVKNAFNKLQEKGIYKAMSEFDIFIN
YIEAYMTMKIRN

>huIL10M1 (WT + GGPSGG Linker (SEQ ID NO: 42)) (SEQ ID NO: 524)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGPSGGKSKAVEQVKNAFNKLQEKGIYKAMSEFDIFIN
YIEAYMTMKIRN

>huIL10M1 (WT + GGGPGG Linker (SEQ ID NO: 43)) (SEQ ID NO: 525)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGPGGKSKAVEQVKNAFNKLQEKGIYKAMSEFDIFIN
YIEAYMTMKIRN

>huIL10M1 (WT + GGGSPG Linker (SEQ ID NO: 44)) (SEQ ID NO: 526)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSPGKSKAVEQVKNAFNKLQEKGIYKAMSEFDIFIN
YIEAYMTMKIRN

>huIL10M1 (WT + GGGSGP Linker (SEQ ID NO: 45)) (SEQ ID NO: 527)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGPKSKAVEQVKNAFNKLQEKGIYKAMSEFDIFIN
YIEAYMTMKIRN

>huIL10M1 (WT + GGGGG Linker (SEQ ID NO: 46)) (SEQ ID NO: 528)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGGGKSKAVEQVKNAFNKLQEKGIYKAMSEFDIFINY
IEAYMTMKIRN

>huIL10M1 (WT + GGGG Linker (SEQ ID NO: 47)) (SEQ ID NO: 529)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGGKSKAVEQVKNAFNKLQEKGIYKAMSEFDIFINYI
EAYMTMKIRN

>huIL10M1 (WT + GGG Linker) (SEQ ID NO: 530)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGKSKAVEQVKNAFNKLQEKGIYKAMSEFDIFINYIE
AYMTMKIRN

Figure 75B

>huIL10M1 (WT + GG Linker)  (SEQ ID NO: 531)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGKSKAVEQVKNAFNKLQEKGIYKAMSEFDIFINYIEA
YMTMKIRN

>huIL10M1 (WT + G Linker)  (SEQ ID NO: 532)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGKSKAVEQVKNAFNKLQEKGIYKAMSEFDIFINYIEAY
MTMKIRN

>huIL10M1 (WT + GGGGSGGGGS Linker (SEQ ID NO: 32))  (SEQ ID NO: 533)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGGSGGGGSKSKAVEQVKNAFNKLQEKGIYKAMSEFD
IFINYIEAYMTMKIRN

Figure 76A

>XENP25769 empty-Fc(216)-huIL10M1.30_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 534)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.30_Fc(216)_IgG1_C220S/S364K/E357Q (SEQ ID NO: 535)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENPGSGGKSKAVEQVKNAFNKLQEKGIYKAMSEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK >XENP25770 empty-Fc(216)-huIL10M1.31_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 536)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.31_Fc(216)_IgG1_C220S/S364K/E357Q (SEQ ID NO: 537)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGPGSGGKSKAVEQVKNAFNKLQEKGIYKAMSEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK >XENP25771 empty-Fc(216)-huIL10M1.32_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 538)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.32_Fc(216)_IgG1_C220S/S364K/E357Q (SEQ ID NO: 539)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGPSGGKSKAVEQVKNAFNKLQEKGIYKAMSEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 76B

>XENP25772 empty-Fc(216)-huIL10M1.33_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 540)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.33_Fc(216)_IgG1_C220S/S364K/E357Q (SEQ ID NO: 541)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGPGGKSKAVEQVKNAFNKLQEKGIYKAMSEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

>XENP25773 empty-Fc(216)-huIL10M1.34_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 542)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.34_Fc(216)_IgG1_C220S/S364K/E357Q (SEQ ID NO: 543)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSPGKSKAVEQVKNAFNKLQEKGIYKAMSEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

>XENP25774 empty-Fc(216)-huIL10M1.35_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 544)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.35_Fc(216)_IgG1_C220S/S364K/E357Q (SEQ ID NO: 545)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGSGPKSKAVEQVKNAFNKLQEKGIYKAMSEFDIFIN
YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

Figure 76C

>XENP25775 empty-Fc(216)-huIL10M1.36_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 546)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.36_Fc(216)_IgG1_C220S/S364K/E357Q (SEQ ID NO: 547)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGGKSKAVEQVKNAFNKLQEKGIYKAMSEFDIFINY
IEAYMTMKIRN*/EPKSSDKTHTCPPCPAPPVAGPSVFLFPPKPKDTLMISRTPEVTCVVVDVKHEDPEVKFNWYVDG
VEVHNAKTKPREEQYNSTYRVVSVLTVLHQDWLNGKEYKCKVSNKALPAPIEKTISKAKGQPREPQVYTLPPSREQM
TKNQVKLTCLVKGFYPSDIAVEWESNGQPENNYKTTPPVLDSDGSFFLYSKLTVDKSRWQQGNVFSCSVMHEALHNH
YTQKSLSLSPGK

>XENP25776 empty-Fc(216)-huIL10M1.37_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 548)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.37_Fc(216)_IgG1_C220S/S364K/E357Q (SEQ ID NO: 549)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGGKSKAVEQVKNAFNKLQEKGIYKAMSEFDIFINYI
EAYMTMKIRN*/EPKSSDKTHTCPPCPAPPVAGPSVFLFPPKPKDTLMISRTPEVTCVVVDVKHEDPEVKFNWYVDGV
EVHNAKTKPREEQYNSTYRVVSVLTVLHQDWLNGKEYKCKVSNKALPAPIEKTISKAKGQPREPQVYTLPPSREQMT
KNQVKLTCLVKGFYPSDIAVEWESNGQPENNYKTTPPVLDSDGSFFLYSKLTVDKSRWQQGNVFSCSVMHEALHNHY
TQKSLSLSPGK

>XENP25777 empty-Fc(216)-huIL10M1.38_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 550)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.38_Fc(216)_IgG1_C220S/S364K/E357Q (SEQ ID NO: 551)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGGKSKAVEQVKNAFNKLQEKGIYKAMSEFDIFINYIE
AYMTMKIRN*/EPKSSDKTHTCPPCPAPPVAGPSVFLFPPKPKDTLMISRTPEVTCVVVDVKHEDPEVKFNWYVDGVE
VHNAKTKPREEQYNSTYRVVSVLTVLHQDWLNGKEYKCKVSNKALPAPIEKTISKAKGQPREPQVYTLPPSREQMTK
NQVKLTCLVKGFYPSDIAVEWESNGQPENNYKTTPPVLDSDGSFFLYSKLTVDKSRWQQGNVFSCSVMHEALHNHYT
QKSLSLSPGK

Figure 76D

>XENP25778 empty-Fc(216)-huIL10M1.39_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 552)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.39_Fc(216)_IgG1_C220S/S364K/E357Q (SEQ ID NO: 553)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGKSKAVEQVKNAFNKLQEKGIYKAMSEFDIFINYIEA
YMTMKIRN*/EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLPPSREQMTKN
QVKLTCLVKGFYPSDIAVEWESNGQPENNYKTTPPVLDSDGSFFLYSKLTVDKSRWQQGNVFSCSVMHEALHNHYTQ
KSLSLSPGK >XENP25779 empty-Fc(216)-huIL10M1.40_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 554)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.40_Fc(216)_IgG1_C220S/S364K/E357Q (SEQ ID NO: 555)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGKSKAVEQVKNAFNKLQEKGIYKAMSEFDIFINYIEAY
MTMKIRN*/EPKSSDKTHTCPPCPAPPVAGPSVFLFPPKPKDTLMISRTPEVTCVVVDVKHEDPEVKFNWYVDGVEVH
NAKTKPREEQYNSTYRVVSVLTVLHQDWLNGKEYKCKVSNKALPAPIEKTISKAKGQPREPQVYTLPPSREQMTKNQ
VKLTCLVKGFYPSDIAVEWESNGQPENNYKTTPPVLDSDGSFFLYSKLTVDKSRWQQGNVFSCSVMHEALHNHYTQK
SLSLSPGK >XENP25780 empty-Fc(216)-huIL10M1.41_Fc(216)_IgG1_PVA_/S267K_pI(-)_Isosteric_A_L368D/K370S-IgG1_C220S/S364K/E357Q

Chain 1 - empty_Fc(216)_IgG1_PVA_/S267K_pI(-)_Isosteric_A_L368D/K370S (SEQ ID NO: 556)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 2 - huIL10M1.41_Fc(216)_IgG1_C220S/S364K/E357Q (SEQ ID NO: 557)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENGGGGSGGGGSKSKAVEQVKNAFNKLQEKGIYKAMSEFD
IFINYIEAYMTMKIRN*/EPKSSDKTHTCPPCPAPPVAGPSVFLFPPKPKDTLMISRTPEVTCVVVDVKHEDPEVKFN
WYVDGVEVHNAKTKPREEQYNSTYRVVSVLTVLHQDWLNGKEYKCKVSNKALPAPIEKTISKAKGQPREPQVYTLPP
SREQMTKNQVKLTCLVKGFYPSDIAVEWESNGQPENNYKTTPPVLDSDGSFFLYSKLTVDKSRWQQGNVFSCSVMHE
ALHNHYTQKSLSLSPGK

Figure 77A

>huIL10(N21D-109H) (SEQ ID NO: 558)
SPGQGTQSENSCTHFPGNLPDMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRN

>huIL10(N21D-109H) (SEQ ID NO: 559)
SPGQGTQSENSCTHFPGNLPDMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRN

>huIL10(D41N-109H) (SEQ ID NO: 560)
SPGQGTQSENSCTHFPGNLPNMLRDLRDAFSRVKTFFQMKNQLDNLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRN

>huIL10(Q42E-109H) (SEQ ID NO: 561)
SPGQGTQSENSCTHFPGNLPNMLRDLRDAFSRVKTFFQMKDELDNLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRN

>huIL10(N45D-109H) (SEQ ID NO: 562)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRN

>huIL10(Q38E-109H) (SEQ ID NO: 563)
SPGQGTQSENSCTHFPGNLPNMLRDLRDAFSRVKTFFEMKDQLDNLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRN

>huIL10(D41N-109H) (SEQ ID NO: 564)
SPGQGTQSENSCTHFPGNLPNMLRDLRDAFSRVKTFFQMKNQLDNLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRN

>huIL10(D144N-109H) (SEQ ID NO: 565)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFNIFINYIEAYM
TMKIRN

>huIL10(E151Q-109H) (SEQ ID NO: 566)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIQAYM
TMKIRN

Figure 77B

>huIL10(N21D/N45D-109H) (SEQ ID NO: 567)
SPGQGTQSENSCTHFPGNLPDMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRN

>huIL10(Q38E/N45D-109H) (SEQ ID NO: 568)
SPGQGTQSENSCTHFPGNLPNMLRDLRDAFSRVKTFFEMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRN

>huIL10(D41N/N45D-109H) (SEQ ID NO: 569)
SPGQGTQSENSCTHFPGNLPNMLRDLRDAFSRVKTFFQMKNQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRN

>huIL10(Q42E/N45D-109H) (SEQ ID NO: 570)
SPGQGTQSENSCTHFPGNLPNMLRDLRDAFSRVKTFFQMKDELDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRN

>huIL10(N45D/D144N-109H) (SEQ ID NO: 571)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFNIFINYIEAYM
TMKIRN

>huIL10(N45D/E151Q-109H) (SEQ ID NO: 572)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIQAYM
TMKIRN

Figure 78A

>XENP30003 empty_Fc(216)-huIL10.100_huIL10.100_(G4S)2_IgG1_pI(-
)_Isosteric_A_C220S/PVA_/S267K/L368D/K370S
-IgG1_C220S/PVA_/S267K/S364K/E357Q XENP30003 Chain 1 - empty_Fc(216)_IgG1_pI(-)_Isosteric_A_C220S/PVA_/S267K/L368D/K370S  (SEQ ID NO: 573)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30003 Chain 2 - huIL10.100_huIL10.100_(G4S)2_IgG1_C220S/PVA_/S267K/S364K/E357Q  (SEQ ID NO: 574)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR\GGGGSGGGGS\EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK >XENP30004 empty_Fc(216)-huIL10.101_huIL10.101_(G4S)2_IgG1_pI(-
)_Isosteric_A_C220S/PVA_/S267K/L368D/K370S
-IgG1_C220S/PVA_/S267K/S364K/E357Q XENP30004 Chain 1 - empty_Fc(216)_IgG1_pI(-)_Isosteric_A_C220S/PVA_/S267K/L368D/K370S  (SEQ ID NO: 575)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30004 Chain 2 - huIL10.101_huIL10.101_(G4S)2_IgG1_C220S/PVA_/S267K/S364K/E357Q  (SEQ ID NO: 576)
SPGQGTQSENSCTHFPGNLPDMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPDMLRDLRDAFSRVKTFFQMKDQLDNLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR\GGGGSGGGGS\EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Figure 78B

>XENP30005 empty_Fc(216)-huIL10.102_huIL10.102_(G4S)2_IgG1_pI(-
)_Isosteric_A_C220S/PVA_/S267K/L368D/K370S
-IgG1_C220S/PVA_/S267K/S364K/E357Q XENP30005 Chain 1 - empty_Fc(216)_IgG1_pI(-)_Isosteric_A_C220S/PVA_/S267K/L368D/K370S (SEQ ID NO:25)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30005 Chain 2 - huIL10.102_huIL10.102_(G4S)2_IgG1_C220S/PVA_/S267K/S364K/E357Q (SEQ ID NO:26)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR\GGGGSGGGGS\EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK >XENP30006 empty_Fc(216)-huIL10.103_huIL10.103_(G4S)2_IgG1_pI(-
)_Isosteric_A_C220S/PVA_/S267K/L368D/K370S
-IgG1_C220S/PVA_/S267K/S364K/E357Q XENP30006 Chain 1 - empty_Fc(216)_IgG1_pI(-)_Isosteric_A_C220S/PVA_/S267K/L368D/K370S (SEQ ID NO: 577)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30006 Chain 2 - huIL10.103_huIL10.103_(G4S)2_IgG1_C220S/PVA_/S267K/S364K/E357Q (SEQ ID NO: 578)
SPGQGTQSENSCTHFPGNLPNMLRDLRDAFSRVKTFFEMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR\GGGGSGGGGS\EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Figure 78C

>XENP30007 empty_Fc(216)-huIL10.104_huIL10.104_(G4S)2_IgG1_pI(-
)_Isosteric_A_C220S/PVA_/S267K/L368D/K370S
-IgG1_C220S/PVA_/S267K/S364K/E357Q XENP30007 Chain 1 - empty_Fc(216)_IgG1_pI(-)_Isosteric_A_C220S/PVA_/S267K/L368D/K370S  (SEQ ID NO: 579)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30007 Chain 2 - huIL10.104_huIL10.104_(G4S)2_IgG1_C220S/PVA_/S267K/S364K/E357Q  (SEQ ID NO: 580)
SPGQGTQSENSCTHFPGNLPNMLRDLRDAFSRVKTFFQMKNQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR\GGGGSGGGGS\EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK >XENP30008 empty_Fc(216)-huIL10.105_huIL10.105_(G4S)2_IgG1_pI(-
)_Isosteric_A_C220S/PVA_/S267K/L368D/K370S
-IgG1_C220S/PVA_/S267K/S364K/E357Q XENP30008 Chain 1 - empty_Fc(216)_IgG1_pI(-)_Isosteric_A_C220S/PVA_/S267K/L368D/K370S  (SEQ ID NO:27)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30008 Chain 2 - huIL10.105_huIL10.105_(G4S)2_IgG1_C220S/PVA_/S267K/S364K/E357Q  (SEQ ID NO:28)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFNIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR\GGGGSGGGGS\EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Figure 78D

>XENP30009 empty_Fc(216)-huIL10.106_huIL10.106_(G4S)2_IgG1_pI(-
)_Isosteric_A_C220S/PVA_/S267K/L368D/K370S
-IgG1_C220S/PVA_/S267K/S364K/E357Q XENP30009 Chain 1 - empty_Fc(216)_IgG1_pI(-)_Isosteric_A_C220S/PVA_/S267K/L368D/K370S  (SEQ ID NO: 581)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30009 Chain 2 - huIL10.106_huIL10.106_(G4S)2_IgG1_C220S/PVA_/S267K/S364K/E357Q  (SEQ ID NO: 582)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIQAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR\GGGGSGGGGS\EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK >XENP30010 empty_Fc(216)-huIL10.107_huIL10.107_(G4S)2_IgG1_pI(-
)_Isosteric_A_C220S/PVA_/S267K/L368D/K370S
-IgG1_C220S/PVA_/S267K/S364K/E357Q XENP30010 Chain 1 - empty_Fc(216)_IgG1_pI(-)_Isosteric_A_C220S/PVA_/S267K/L368D/K370S  (SEQ ID NO: 583)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30010 Chain 2 - huIL10.107_huIL10.107_(G4S)2_IgG1_C220S/PVA_/S267K/S364K/E357Q  (SEQ ID NO: 584)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPDMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR\GGGGSGGGGS\EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Figure 78E

>XENP30011 empty_Fc(216)-huIL10.108_huIL10.108_(G4S)2_IgG1_pI(-
)_Isosteric_A_C220S/PVA_/S267K/L368D/K370S
-IgG1_C220S/PVA_/S267K/S364K/E357Q XENP30011 Chain 1 - empty_Fc(216)_IgG1_pI(-)_Isosteric_A_C220S/PVA_/S267K/L368D/K370S (SEQ ID NO: 585)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30011 Chain 2 - huIL10.108_huIL10.108_(G4S)2_IgG1_C220S/PVA_/S267K/S364K/E357Q (SEQ ID NO: 586)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFNIFIN
YIEAYMTMKIR\GGGGSGGGGS\EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK >XENP30012 empty_Fc(216)-huIL10.109_huIL10.109_(G4S)2_IgG1_pI(-
)_Isosteric_A_C220S/PVA_/S267K/L368D/K370S
-IgG1_C220S/PVA_/S267K/S364K/E357Q XENP30012 Chain 1 - empty_Fc(216)_IgG1_pI(-)_Isosteric_A_C220S/PVA_/S267K/L368D/K370S (SEQ ID NO: 587)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30012 Chain 2 - huIL10.109_huIL10.109_(G4S)2_IgG1_C220S/PVA_/S267K/S364K/E357Q (SEQ ID NO: 588)
SPGQGTQSENSCTHFPGNLPDMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPDMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR\GGGGSGGGGS\EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Figure 78F

>XENP30013 empty_Fc(216)-huIL10.110_huIL10.110_(G4S)2_IgG1_pI(-
)_Isosteric_A_C220S/PVA_/S267K/L368D/K370S
-IgG1_C220S/PVA_/S267K/S364K/E357Q XENP30013 Chain 1 - empty_Fc(216)_IgG1_pI(-)_Isosteric_A_C220S/PVA_/S267K/L368D/K370S  (SEQ ID NO:29)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30013 Chain 2 - huIL10.110_huIL10.110_(G4S)2_IgG1_C220S/PVA_/S267K/S364K/E357Q  (SEQ ID NO:30)
SPGQGTQSENSCTHFPGNLPNMLRDLRDAFSRVKTFFEMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFEMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR\GGGGSGGGGS\EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK >XENP30014 empty_Fc(216)-huIL10.111_huIL10.111_(G4S)2_IgG1_pI(-
)_Isosteric_A_C220S/PVA_/S267K/L368D/K370S
-IgG1_C220S/PVA_/S267K/S364K/E357Q XENP30014 Chain 1 - empty_Fc(216)_IgG1_pI(-)_Isosteric_A_C220S/PVA_/S267K/L368D/K370S  (SEQ ID NO: 589)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30014 Chain 2 - huIL10.111_huIL10.111_(G4S)2_IgG1_C220S/PVA_/S267K/S364K/E357Q  (SEQ ID NO: 590)
SPGQGTQSENSCTHFPGNLPNMLRDLRDAFSRVKTFFQMKDELDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDELDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR\GGGGSGGGGS\EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Figure 78G

>XENP30015 empty_Fc(216)-huIL10.112_huIL10.112_(G4S)2_IgG1_pI(-
)_Isosteric_A_C220S/PVA_/S267K/L368D/K370S
-IgG1_C220S/PVA_/S267K/S364K/E357Q XENP30015 Chain 1 - empty_Fc(216)_IgG1_pI(-)_Isosteric_A_C220S/PVA_/S267K/L368D/K370S (SEQ ID NO: 591)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30015 Chain 2 - huIL10.112_huIL10.112_(G4S)2_IgG1_C220S/PVA_/S267K/S364K/E357Q (SEQ ID NO: 592)
SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIQAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIQAYMTMKIR\GGGGSGGGGS\EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Figure 79A

>XENP30016 empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10.100_huIL10.100

XENP30016 Chain 1 - empty_Fc-IgG1_pI(-)_Isosteric_A_PVA_/S267K/L368D/K370S (SEQ ID NO: 593)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

XENP30016 Chain 2 - Fc(216)_IgG1_C220S/PVA_/S267K/S364K/E357Q/K447del_(G4S)3_huIL10.100_huIL10.100 (SEQ ID NO: 594)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
GGGGSGGGGSGGGGS/SPGQGTQSENSCTHFPGNLPNMLRDLRDAFSRVKTFFQMKDQLDNLLLKESLLEDFKGYLG
CQALSEMIQFYLEEVMPQAENQDPDIKAHVNSLGENLKTLRLRLRRCHRFLPCENKSKAVEQVKNAFNKLQEKGIYK
AMSEFDIFINYIEAYMTMKIRNSPGQGTQSENSCTHFPGNLPNMLRDLRDAFSRVKTFFQMKDQLDNLLLKESLLED
FKGYLGCQALSEMIQFYLEEVMPQAENQDPDIKAHVNSLGENLKTLRLRLRRCHRFLPCENKSKAVEQVKNAFNKLQ
EKGIYKAMSEFDIFINYIEAYMTMKIRN >XENP30017 empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10.101_huIL10.101

XENP30017 Chain 1 - empty_Fc-IgG1_pI(-)_Isosteric_A_PVA_/S267K/L368D/K370S (SEQ ID NO: 595)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

XENP30017 Chain 2 - Fc(216)_IgG1_C220S/PVA_/S267K/S364K/E357Q/K447del_(G4S)3_huIL10.101_huIL10.101 (SEQ ID NO: 596)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
GGGGSGGGGSGGGGS/SPGQGTQSENSCTHFPGNLPDMLRDLRDAFSRVKTFFQMKDQLDNLLLKESLLEDFKGYLG
CQALSEMIQFYLEEVMPQAENQDPDIKAHVNSLGENLKTLRLRLRRCHRFLPCENKSKAVEQVKNAFNKLQEKGIYK
AMSEFDIFINYIEAYMTMKIRNSPGQGTQSENSCTHFPGNLPDMLRDLRDAFSRVKTFFQMKDQLDNLLLKESLLED
FKGYLGCQALSEMIQFYLEEVMPQAENQDPDIKAHVNSLGENLKTLRLRLRRCHRFLPCENKSKAVEQVKNAFNKLQ
EKGIYKAMSEFDIFINYIEAYMTMKIRN

Figure 79B

>XENP30018_empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10.102_huIL10.102

XENP30018 Chain 1 - empty_Fc-IgG1_pI(-)_Isosteric_A_PVA_/S267K/L368D/K370S (SEQ ID NO: 597)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30018 Chain 2 - Fc(216)_IgG1_C220S/PVA_/S267K/S364K/E357Q/K447del_(G4S)3_huIL10.102_huIL10.102
(SEQ ID NO: 598)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
<u>GGGGSGGGGSGGGGS</u>/*SPGQGTQSENSCTHFPGNLPNMLRDLRDAFSRVKTFFQMKDQLDDLLLKESLLEDFKGYLG
CQALSEMIQFYLEEVMPQAENQDPDIKAHVNSLGENLKTLRLRLRRCHRFLPCENKSKAVEQVKNAFNKLQEKGIYK
AMSEFDIFINYIEAYMTMKIRNSPGQGTQSENSCTHFPGNLPNMLRDLRDAFSRVKTFFQMKDQLDDLLLKESLLED
FKGYLGCQALSEMIQFYLEEVMPQAENQDPDIKAHVNSLGENLKTLRLRLRRCHRFLPCENKSKAVEQVKNAFNKLQ
EKGIYKAMSEFDIFINYIEAYMTMKIRN*

>XENP30019_empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10.103_huIL10.103

XENP30019 Chain 1 - empty_Fc-IgG1_pI(-)_Isosteric_A_PVA_/S267K/L368D/K370S (SEQ ID NO: 599)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30019 Chain 2 - Fc(216)_IgG1_C220S/PVA_/S267K/S364K/E357Q/K447del_(G4S)3_huIL10.103_huIL10.103
(SEQ ID NO: 600)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
<u>GGGGSGGGGSGGGGS</u>/*SPGQGTQSENSCTHFPGNLPNMLRDLRDAFSRVKTFFEMKDQLDDLLLKESLLEDFKGYLG
CQALSEMIQFYLEEVMPQAENQDPDIKAHVNSLGENLKTLRLRLRRCHRFLPCENKSKAVEQVKNAFNKLQEKGIYK
AMSEFDIFINYIEAYMTMKIRNSPGQGTQSENSCTHFPGNLPNMLRDLRDAFSRVKTFFQMKDQLDDLLLKESLLED
FKGYLGCQALSEMIQFYLEEVMPQAENQDPDIKAHVNSLGENLKTLRLRLRRCHRFLPCENKSKAVEQVKNAFNKLQ
EKGIYKAMSEFDIFINYIEAYMTMKIRN*

Figure 79C

>XENP30020 empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10.104_huIL10.104

XENP30020 Chain 1 - empty_Fc-IgG1_pI(-)_Isosteric_A_PVA_/S267K/L368D/K370S (SEQ ID NO: 601)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30020 Chain 2 - Fc(216)_IgG1_C220S/PVA_/S267K/S364K/E357Q/K447del_(G4S)3_huIL10.104_huIL10.104 (SEQ ID NO: 602)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
<u>GGGGSGGGGSGGGGS</u>/*SPGQGTQSENSCTHFPGNLPNMLRDLRDAFSRVKTFFQMKNQLDDLLLKESLLEDFKGYLG
CQALSEMIQFYLEEVMPQAENQDPDIKAHVNSLGENLKTLRLRLRRCHRFLPCENKSKAVEQVKNAFNKLQEKGIYK
AMSEFDIFINYIEAYMTMKIRNSPGQGTQSENSCTHFPGNLPNMLRDLRDAFSRVKTFFQMKDQLDDLLLKESLLED
FKGYLGCQALSEMIQFYLEEVMPQAENQDPDIKAHVNSLGENLKTLRLRLRRCHRFLPCENKSKAVEQVKNAFNKLQ
EKGIYKAMSEFDIFINYIEAYMTMKIRN*

>XENP30021 empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10.105_huIL10.105

XENP30021 Chain 1 - empty_Fc-IgG1_pI(-)_Isosteric_A_PVA_/S267K/L368D/K370S (SEQ ID NO: 603)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30021 Chain 2 - Fc(216)_IgG1_C220S/PVA_/S267K/S364K/E357Q/K447del_(G4S)3_huIL10.105_huIL10.105 (SEQ ID NO: 604)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
<u>GGGGSGGGGSGGGGS</u>/*SPGQGTQSENSCTHFPGNLPNMLRDLRDAFSRVKTFFQMKDQLDDLLLKESLLEDFKGYLG
CQALSEMIQFYLEEVMPQAENQDPDIKAHVNSLGENLKTLRLRLRRCHRFLPCENKSKAVEQVKNAFNKLQEKGIYK
AMSEFNIFINYIEAYMTMKIRNSPGQGTQSENSCTHFPGNLPNMLRDLRDAFSRVKTFFQMKDQLDDLLLKESLLED
FKGYLGCQALSEMIQFYLEEVMPQAENQDPDIKAHVNSLGENLKTLRLRLRRCHRFLPCENKSKAVEQVKNAFNKLQ
EKGIYKAMSEFDIFINYIEAYMTMKIRN*

Figure 79D

<u>>XENP30022 empty_Fc-IgG1_pI(-)_Isosteric_A_PVA_/S267K/L368D/K370S-</u>
<u>Fc(216)_IgG1_C220S/PVA_/S267K/S364K/E357Q/K447del_(G4S)3_huIL10.106_huIL10.106</u>

XENP30022 Chain 1 - empty_Fc-IgG1_pI(-)_Isosteric_A_PVA_/S267K/L368D/K370S (SEQ ID NO: 605)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30022 Chain 2 - Fc(216)_IgG1_C220S/PVA_/S267K/S364K/E357Q/K447del_(G4S)3_huIL10.106_huIL10.106
(SEQ ID NO: 606)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
<u>GGGGSGGGGSGGGGS</u>/*SPGQGTQSENSCTHFPGNLPNMLRDLRDAFSRVKTFFQMKDQLDDLLLKESLLEDFKGYLG*
*CQALSEMIQFYLEEVMPQAENQDPDIKAHVNSLGENLKTLRLRLRRCHRFLPCENKSKAVEQVKNAFNKLQEKGIYK*
*AMSEFDIFINYIQAYMTMKIRNSPGQGTQSENSCTHFPGNLPNMLRDLRDAFSRVKTFFQMKDQLDDLLLKESLLED*
*FKGYLGCQALSEMIQFYLEEVMPQAENQDPDIKAHVNSLGENLKTLRLRLRRCHRFLPCENKSKAVEQVKNAFNKLQ*
*EKGIYKAMSEFDIFINYIEAYMTMKIRN*

<u>>XENP30023 empty_Fc-IgG1_pI(-)_Isosteric_A_PVA_/S267K/L368D/K370S-</u>
<u>Fc(216)_IgG1_C220S/PVA_/S267K/S364K/E357Q/K447del_(G4S)3_huIL10.107_huIL10.107</u>

XENP30023 Chain 1 - empty_Fc-IgG1_pI(-)_Isosteric_A_PVA_/S267K/L368D/K370S (SEQ ID NO: 607)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30023 Chain 2 - Fc(216)_IgG1_C220S/PVA_/S267K/S364K/E357Q/K447del_(G4S)3_huIL10.107_huIL10.107
(SEQ ID NO: 608)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
<u>GGGGSGGGGSGGGGS</u>/*SPGQGTQSENSCTHFPGNLPNMLRDLRDAFSRVKTFFQMKDQLDDLLLKESLLEDFKGYLG*
*CQALSEMIQFYLEEVMPQAENQDPDIKAHVNSLGENLKTLRLRLRRCHRFLPCENKSKAVEQVKNAFNKLQEKGIYK*
*AMSEFDIFINYIEAYMTMKIRNSPGQGTQSENSCTHFPGNLPDMLRDLRDAFSRVKTFFQMKDQLDDLLLKESLLED*
*FKGYLGCQALSEMIQFYLEEVMPQAENQDPDIKAHVNSLGENLKTLRLRLRRCHRFLPCENKSKAVEQVKNAFNKLQ*
*EKGIYKAMSEFDIFINYIEAYMTMKIRN*

Figure 79E

>XENP30024 empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10.108_huIL10.108

XENP30024 Chain 1 - empty_Fc-IgG1_pI(-)_Isosteric_A_PVA_/S267K/L368D/K370S (SEQ ID NO: 609)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30024 Chain 2 - Fc(216)_IgG1_C220S/PVA_/S267K/S364K/E357Q/K447del_(G4S)3_huIL10.108_huIL10.108
(SEQ ID NO: 610)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
*GGGGSGGGGSGGGGS*/*SPGQGTQSENSCTHFPGNLPNMLRDLRDAFSRVKTFFQMKDQLDDLLLKESLLEDFKGYLG*
*CQALSEMIQFYLEEVMPQAENQDPDIKAHVNSLGENLKTLRLRLRRCHRFLPCENKSKAVEQVKNAFNKLQEKGIYK*
*AMSEFDIFINYIEAYMTMKIRNSPGQGTQSENSCTHFPGNLPNMLRDLRDAFSRVKTFFQMKDQLDDLLLKESLLED*
*FKGYLGCQALSEMIQFYLEEVMPQAENQDPDIKAHVNSLGENLKTLRLRLRRCHRFLPCENKSKAVEQVKNAFNKLQ*
*EKGIYKAMSEFNIFINYIEAYMTMKIRN*

>XENP30025 empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10.109_huIL10.109

XENP30025 Chain 1 - empty_Fc-IgG1_pI(-)_Isosteric_A_PVA_/S267K/L368D/K370S (SEQ ID NO: 611)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30025 Chain 2 - Fc(216)_IgG1_C220S/PVA_/S267K/S364K/E357Q/K447del_(G4S)3_huIL10.109_huIL10.109
(SEQ ID NO: 612)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
*GGGGSGGGGSGGGGS*/*SPGQGTQSENSCTHFPGNLPDMLRDLRDAFSRVKTFFQMKDQLDDLLLKESLLEDFKGYLG*
*CQALSEMIQFYLEEVMPQAENQDPDIKAHVNSLGENLKTLRLRLRRCHRFLPCENKSKAVEQVKNAFNKLQEKGIYK*
*AMSEFDIFINYIEAYMTMKIRNSPGQGTQSENSCTHFPGNLPDMLRDLRDAFSRVKTFFQMKDQLDDLLLKESLLED*
*FKGYLGCQALSEMIQFYLEEVMPQAENQDPDIKAHVNSLGENLKTLRLRLRRCHRFLPCENKSKAVEQVKNAFNKLQ*
*EKGIYKAMSEFDIFINYIEAYMTMKIRN*

Figure 79F

>XENP30026 empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10.110_huIL10.110

XENP30026 Chain 1 - empty_Fc-IgG1_pI(-)_Isosteric_A_PVA_/S267K/L368D/K370S (SEQ ID NO: 613)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30026 Chain 2 - Fc(216)_IgG1_C220S/PVA_/S267K/S364K/E357Q/K447del_(G4S)3_huIL10.110_huIL10.110
(SEQ ID NO: 614)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
<u>GGGGSGGGGSGGGGS</u>/*SPGQGTQSENSCTHFPGNLPNMLRDLRDAFSRVKTFFEMKDQLDDLLLKESLLEDFKGYLG*
*CQALSEMIQFYLEEVMPQAENQDPDIKAHVNSLGENLKTLRLRLRRCHRFLPCENKSKAVEQVKNAFNKLQEKGIYK*
*AMSEFDIFINYIEAYMTMKIRNSPGQGTQSENSCTHFPGNLPNMLRDLRDAFSRVKTFFEMKDQLDDLLLKESLLED*
*FKGYLGCQALSEMIQFYLEEVMPQAENQDPDIKAHVNSLGENLKTLRLRLRRCHRFLPCENKSKAVEQVKNAFNKLQ*
*EKGIYKAMSEFDIFINYIEAYMTMKIRN*

>XENP30027 empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10.111_huIL10.111

XENP30027 Chain 1 - empty_Fc-IgG1_pI(-)_Isosteric_A_PVA_/S267K/L368D/K370S (SEQ ID NO: 615)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30027 Chain 2 - Fc(216)_IgG1_C220S/PVA_/S267K/S364K/E357Q/K447del_(G4S)3_huIL10.111_huIL10.111
(SEQ ID NO: 616)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
<u>GGGGSGGGGSGGGGS</u>/*SPGQGTQSENSCTHFPGNLPNMLRDLRDAFSRVKTFFQMKDELDDLLLKESLLEDFKGYLG*
*CQALSEMIQFYLEEVMPQAENQDPDIKAHVNSLGENLKTLRLRLRRCHRFLPCENKSKAVEQVKNAFNKLQEKGIYK*
*AMSEFDIFINYIEAYMTMKIRNSPGQGTQSENSCTHFPGNLPNMLRDLRDAFSRVKTFFQMKDELDDLLLKESLLED*
*FKGYLGCQALSEMIQFYLEEVMPQAENQDPDIKAHVNSLGENLKTLRLRLRRCHRFLPCENKSKAVEQVKNAFNKLQ*
*EKGIYKAMSEFDIFINYIEAYMTMKIRN*

Figure 79G

>XENP30028 empty_Fc-IgG1_pI(-)_Isosteric_A_PVA_/S267K/L368D/K370S-
Fc(216)_IgG1_C220S/PVA_/S267K/S364K/E357Q/K447del_(G4S)3_huIL10.112_huIL10.112

XENP30028 Chain 1 - empty_Fc-IgG1_pI(-)_Isosteric_A_PVA_/S267K/L368D/K370S  (SEQ ID NO: 617)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK XENP30028 Chain 2 - Fc(216)_IgG1_C220S/PVA_/S267K/S364K/E357Q/K447del_(G4S)3_huIL10.112_huIL10.112
(SEQ ID NO: 618)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
GGGGSGGGGSGGGGS/SPGQGTQSENSCTHFPGNLPNMLRDLRDAFSRVKTFFQMKDQLDDLLLKESLLEDFKGYLG
CQALSEMIQFYLEEVMPQAENQDPDIKAHVNSLGENLKTLRLRLRRCHRFLPCENKSKAVEQVKNAFNKLQEKGIYK
AMSEFDIFINYIQAYMTMKIRNSPGQGTQSENSCTHFPGNLPNMLRDLRDAFSRVKTFFQMKDQLDDLLLKESLLED
FKGYLGCQALSEMIQFYLEEVMPQAENQDPDIKAHVNSLGENLKTLRLRLRRCHRFLPCENKSKAVEQVKNAFNKLQ
EKGIYKAMSEFDIFINYIQAYMTMKIRN

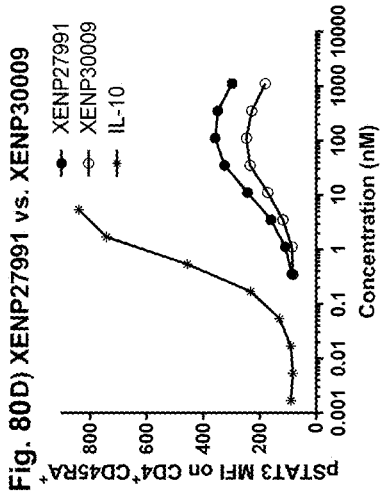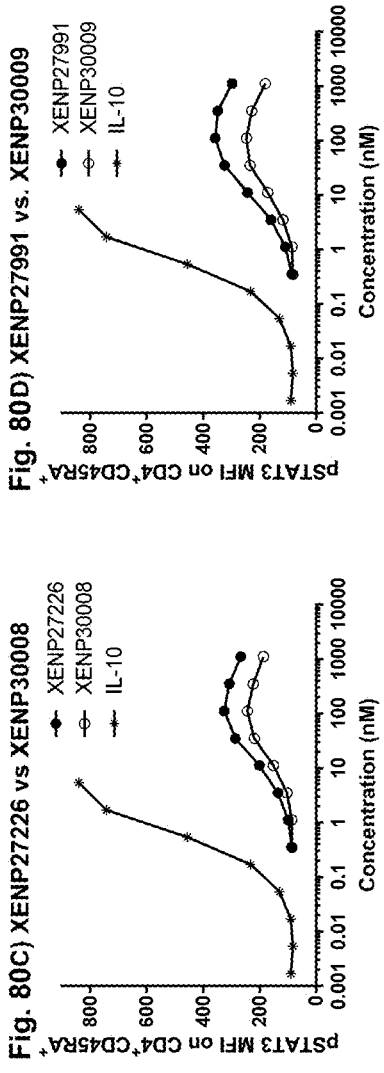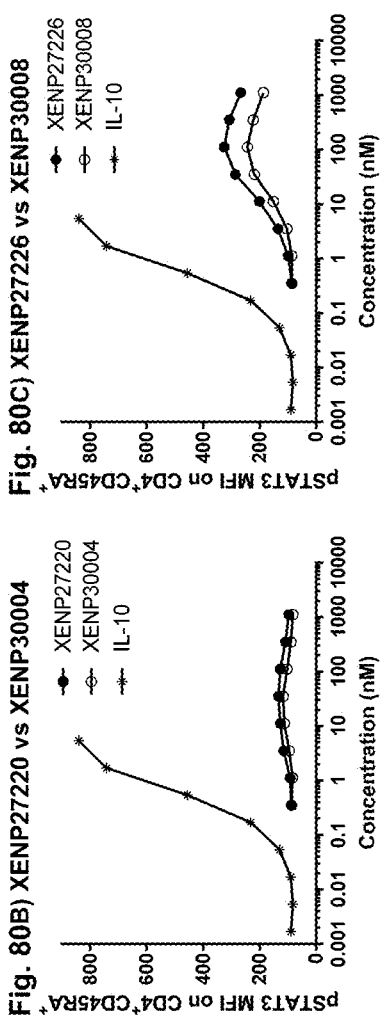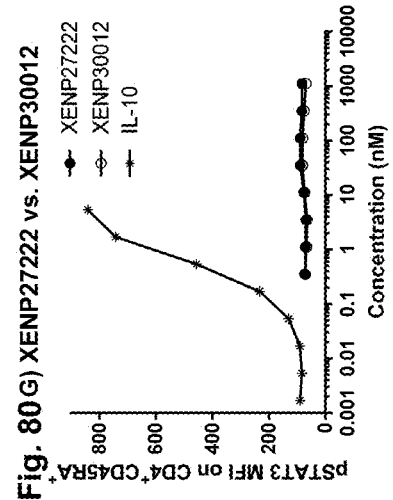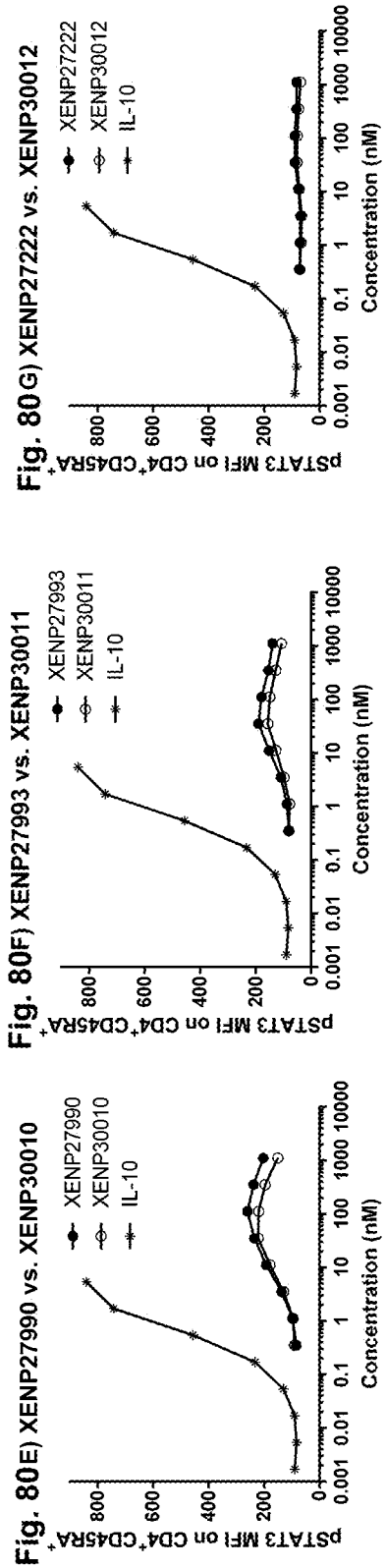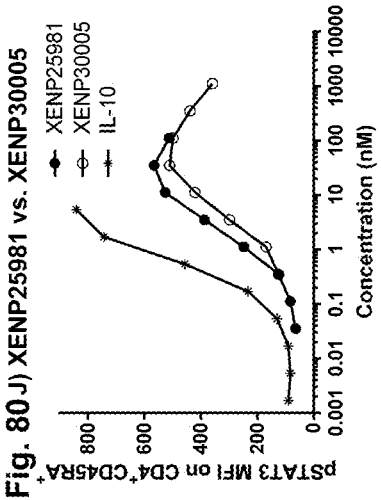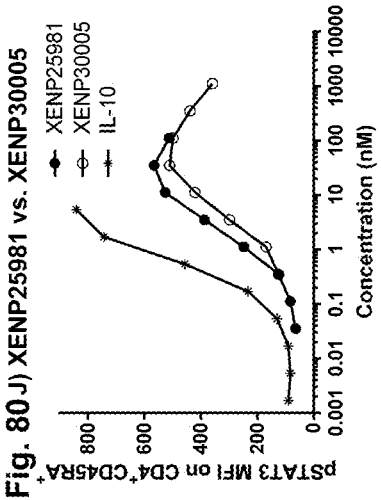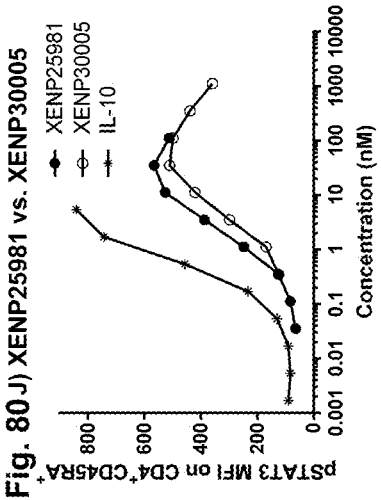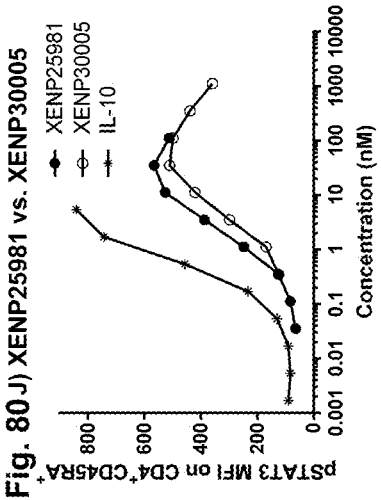

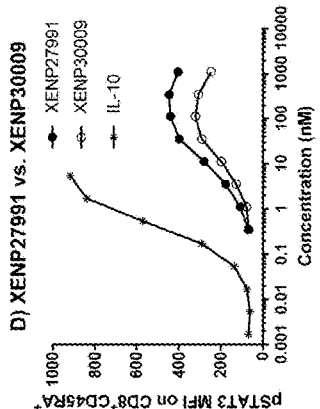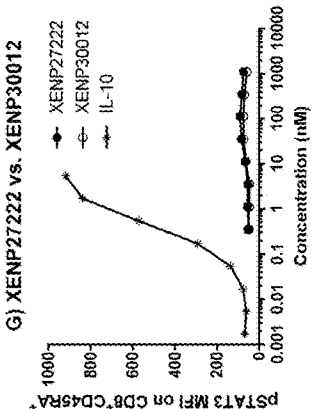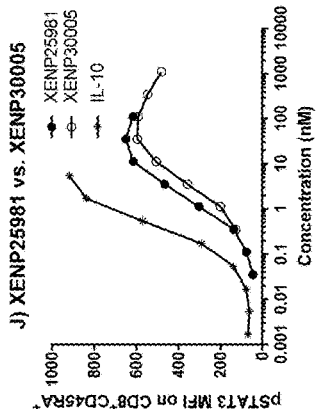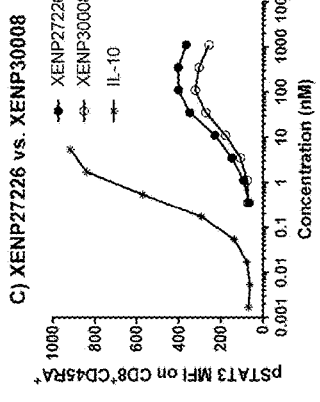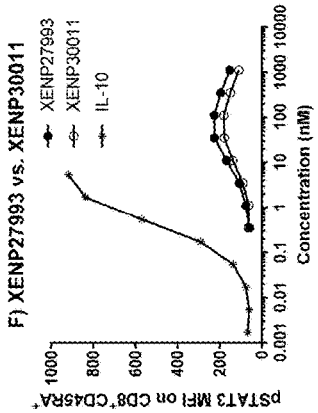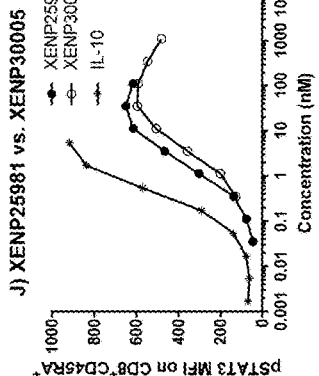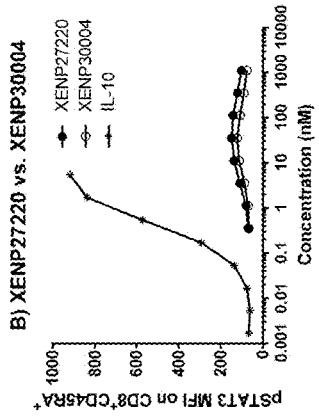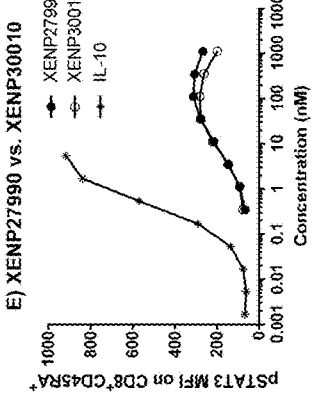

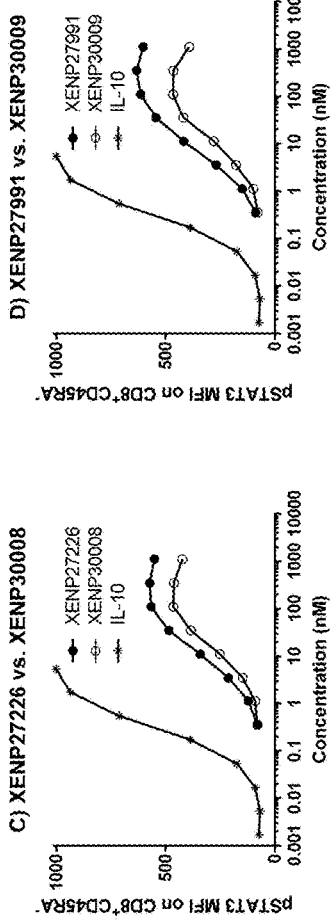
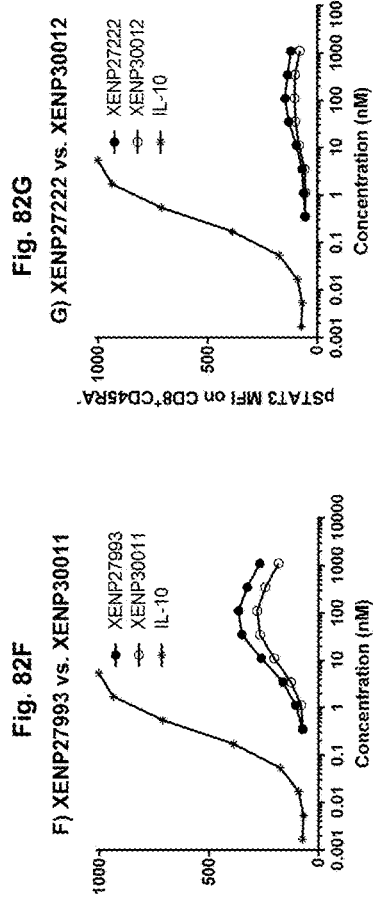
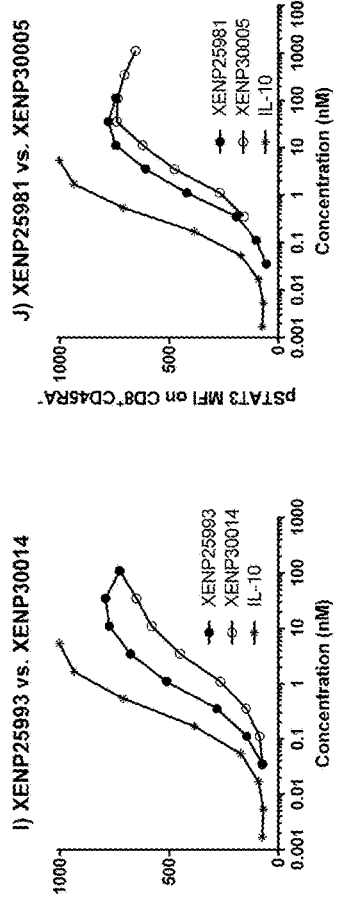

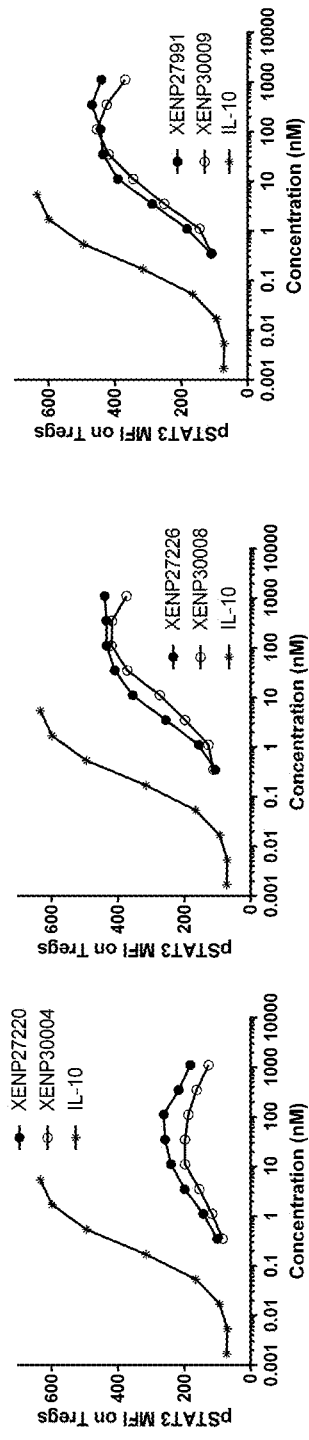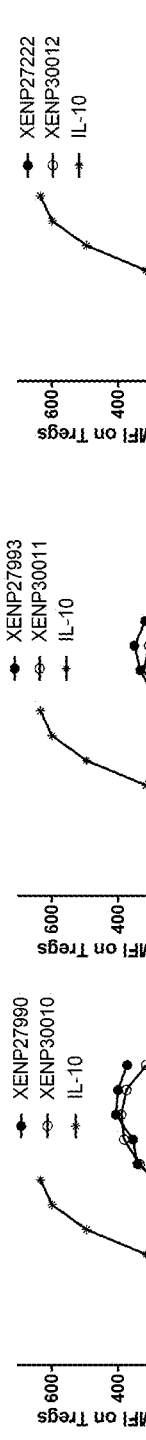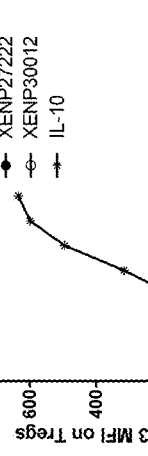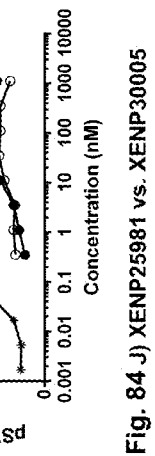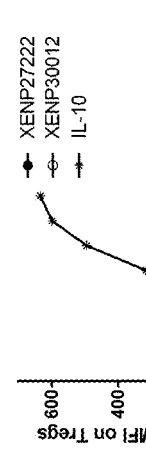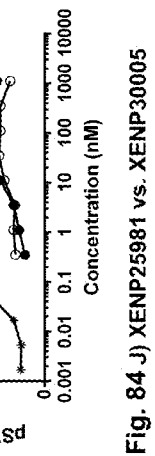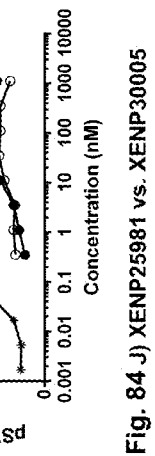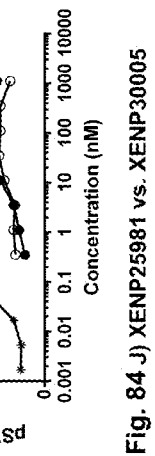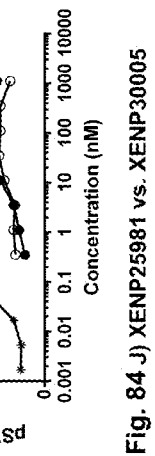

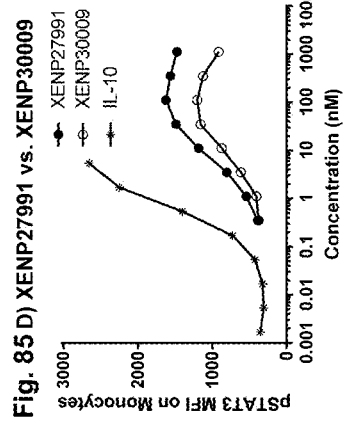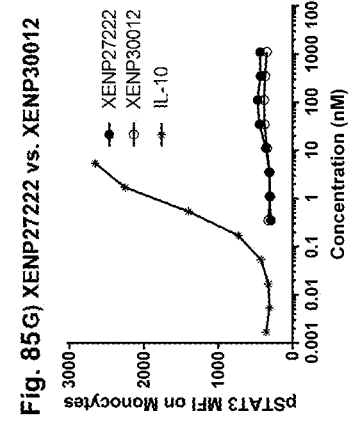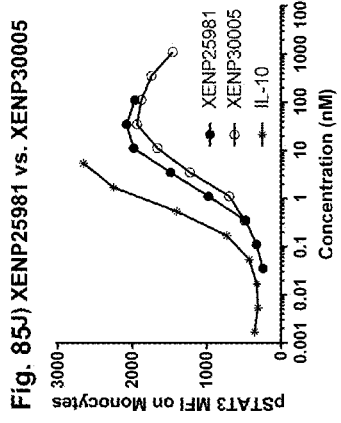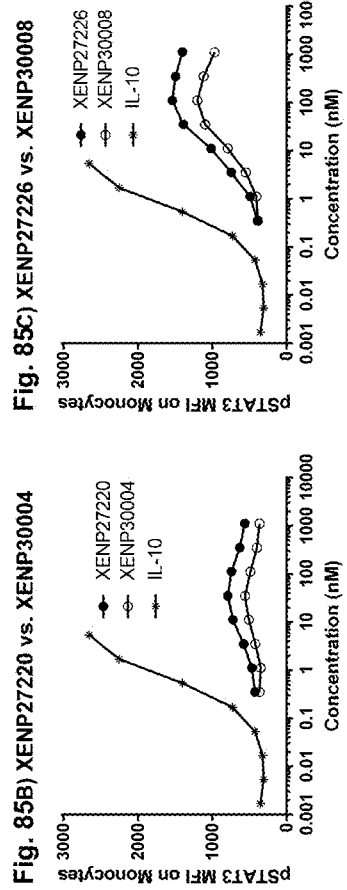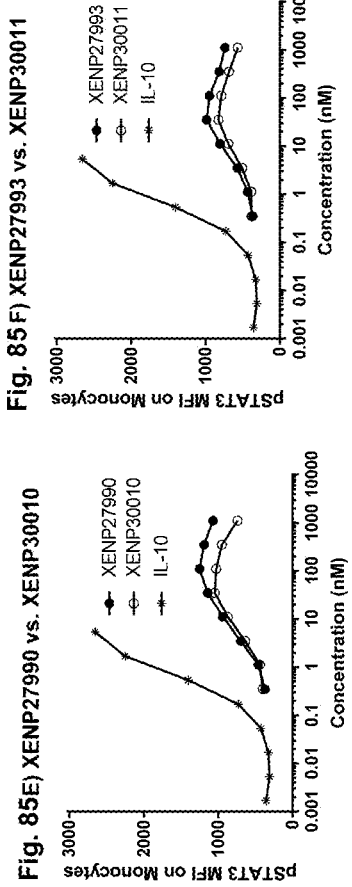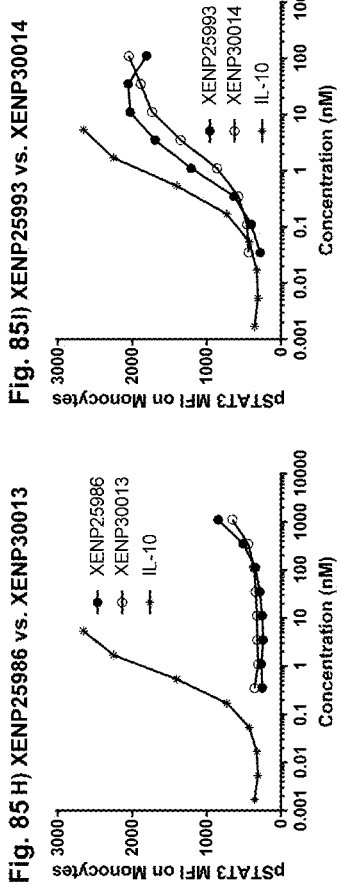

Figure 86A

XENP31091 empty_Fc(216)-huIL10.102_huIL10.102_(G4S)2_IgG1_pI(-)_Isosteric_A_C220S/PVA_/S267K/L368D/K370S/M428L/N434S-IgG1_C220S/PVA_/S267K/S364K/E357Q/M428L/N434S

Chain 1 - empty_Fc(216)_IgG1_pI(-)_Isosteric_A_C220S/PVA_/S267K/L368D/K370S/M428L/N434S (SEQ ID NO: 619)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVLHEALHSHYTQKSLSLSPGK Chain 2 - huIL10.102_huIL10.102_(G4S)2_IgG1_C220S/PVA_/S267K/S364K/E357Q/M428L/N434S (SEQ ID NO: 620)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR*/GGGGSGGGGS/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVLHEALHSHYTQKSLSLSPGK

XENP31092 empty_Fc(216)-huIL10.105_huIL10.105_(G4S)2_IgG1_pI(-)_Isosteric_A_C220S/PVA_/S267K/L368D/K370S/M428L/N434S-IgG1_C220S/PVA_/S267K/S364K/E357Q/M428L/N434S

Chain 1 - empty_Fc(216)_IgG1_pI(-)_Isosteric_A_C220S/PVA_/S267K/L368D/K370S/M428L/N434S (SEQ ID NO: 621)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVLHEALHSHYTQKSLSLSPGK Chain 2 - huIL10.105_huIL10.105_(G4S)2_IgG1_C220S/PVA_/S267K/S364K/E357Q/M428L/N434S (SEQ ID NO: 622)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFNIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR*/GGGGSGGGGS/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVLHEALHSHYTQKSLSLSPGK

XENP31093 empty_Fc(216)-huIL10.110_huIL10.110_(G4S)2_IgG1_pI(-)_Isosteric_A_C220S/PVA_/S267K/L368D/K370S/M428L/N434S-IgG1_C220S/PVA_/S267K/S364K/E357Q/M428L/N434S

Chain 1 - empty_Fc(216)_IgG1_pI(-)_Isosteric_A_C220S/PVA_/S267K/L368D/K370S/M428L/N434S (SEQ ID NO: 623)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVLHEALHSHYTQKSLSLSPGK

Figure 86B

Chain 2 - huIL10.110_huIL10.110_(G4S)2_IgG1_C220S/PVA_/S267K/S364K/E357Q/M428L/N434S (SEQ ID NO: 624)

*SPGQGTQSENSCTHFPGNLPNMLRDLRDAFSRVKTFFEMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFEMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR/*<u>GGGGSGGGGS</u>*/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVLHEALHSHYTQKSLSLSPGK*

<u>**XENP31094 empty_Fc(216)-huIL10.102_huIL10.102_(G4S)2_IgG1_pI(-
)_Isosteric_A_C220S/PVA_/S267K/L368D/K370S/M428L/N434S/G446del/K447del-
IgG1_C220S/PVA_/S267K/S364K/E357Q/M428L/N434S/G446del/K447del**</u>

**Chain 1 - empty_Fc(216)_IgG1_pI(-
)_Isosteric_A_C220S/PVA_/S267K/L368D/K370S/M428L/N434S/G446del/K447del (SEQ ID NO: 625)**
EPKSSDKTHTCPPCPAPPVAGPSVFLFPPKPKDTLMISRTPEVTCVVVDVKHEDPEVKFNWYVDGVEVHNAKTKPRE
EYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVLHEALHSHYTQKSLSLSP

**Chain 2 -
huIL10.102_huIL10.102_(G4S)2_IgG1_C220S/PVA_/S267K/S364K/E357Q/M428L/N434S/G446del/K447del (SEQ ID NO: 626)**
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR/*<u>GGGGSGGGGS</u>*/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVLHEALHSHYTQKSLSLSP*

<u>**XENP31095 empty_Fc(216)-huIL10.105_huIL10.105_(G4S)2_IgG1_pI(-
)_Isosteric_A_C220S/PVA_/S267K/L368D/K370S/M428L/N434S/G446del/K447del-
IgG1_C220S/PVA_/S267K/S364K/E357Q/M428L/N434S/G446del/K447del**</u>

**Chain 1 - empty_Fc(216)_IgG1_pI(-
)_Isosteric_A_C220S/PVA_/S267K/L368D/K370S/M428L/N434S/G446del/K447del (SEQ ID NO: 627)**
EPKSSDKTHTCPPCPAPPVAGPSVFLFPPKPKDTLMISRTPEVTCVVVDVKHEDPEVKFNWYVDGVEVHNAKTKPRE
EYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVLHEALHSHYTQKSLSLSP

**Chain 2 -
huIL10.105_huIL10.105_(G4S)2_IgG1_C220S/PVA_/S267K/S364K/E357Q/M428L/N434S/G446del/K447del (SEQ ID NO: 628)**
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFNIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR/*<u>GGGGSGGGGS</u>*/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVLHEALHSHYTQKSLSLSP*

Figure 86C

XENP31096 empty_Fc(216)-huIL10.110_huIL10.110_(G4S)2_IgG1_pI(-)_Isosteric_A_C220S/PVA_/S267K/L368D/K370S/M428L/N434S/G446del/K447del-IgG1_C220S/PVA_/S267K/S364K/E357Q/M428L/N434S/G446del/K447del

Chain 1 - empty_Fc(216)_IgG1_pI(-)_Isosteric_A_C220S/PVA_/S267K/L368D/K370S/M428L/N434S/G446del/K447del (SEQ ID NO: 629)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSGSFFLYSKLTVDKSRWEQGDVFSCSVLHEALHSHYTQKSLSLSP

Chain 2 - huIL10.110_huIL10.110_(G4S)2_IgG1_C220S/PVA_/S267K/S364K/E357Q/M428L/N434S/G446del/K447del (SEQ ID NO: 630)
*SPGQGTQSENSCTHFPGNLPNMLRDLRDAFSRVKTFFEMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFEMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR*/GGGGSGGGGS/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVLHEALHSHYTQKSLSLSP

XENP31830 empty_Fc(216)-huIL10.100_huIL10.100_(G4S)2_IgG1_pI(-)_Isosteric_A_C220S/PVA_/S267K/L368D/K370S/M428L/N434S-IgG1_C220S/PVA_/S267K/S364K/E357Q/M428L/N434S

Chain 1 - empty_Fc(216)_IgG1_pI(-)_Isosteric_A_C220S/PVA_/S267K/L368D/K370S/M428L/N434S (SEQ ID NO: 631)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSGSFFLYSKLTVDKSRWEQGDVFSCSVLHEALHSHYTQKSLSLSPGK

Chain 2 - huIL10.100_huIL10.100_(G4S)2_IgG1_C220S/PVA_/S267K/S364K/E357Q/M428L/N434S (SEQ ID NO: 632)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR*/GGGGSGGGGS/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVLHEALHSHYTQKSLSLSPGK

Figure 86D

<u>XENP31831 empty_Fc(216)-huIL10.100_huIL10.100_(G4S)2_IgG1_pI(-
)_Isosteric_A_C220S/PVA_/S267K/L368D/K370S/M428L/N434S/G446del/K447del-
IgG1_C220S/PVA_/S267K/S364K/E357Q/M428L/N434S/G446del/K447del</u>

**Chain 1 - empty_Fc(216)_IgG1_pI(-
)_Isosteric_A_C220S/PVA_/S267K/L368D/K370S/M428L/N434S/G446del/K447del (SEQ ID NO: 633)**

EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVLHEALHSHYTQKSLSLSP

**Chain 2 -
huIL10.100_huIL10.100_(G4S)2_IgG1_C220S/PVA_/S267K/S364K/E357Q/M428L/N434S/G446del/K447del (SEQ ID NO: 634)**

*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR*/<u>GGGGSGGGGS</u>/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVLHEALHSHYTQKSLSLSP scIL10-(anti-X)₂-heteroFc

Figure 91A

XENP31273 Numax_Fab-huIL10.102_huIL10.102_(G4S)2-IgG1_pI(-)_Isosteric_A_PVA_/S267K/L368D/K370S-IgG1_C220S/PVA_/S267K/S364K/E357Q

Chain 1 - Numax_VH_IgG1_pI(-)_Isosteric_A_PVA_/S267K/L368D/K370S (SEQ ID NO: 635)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - huIL10.102_huIL10.102_(G4S)2_IgG1_C220S/PVA_/S267K/S364K/E357Q (SEQ ID NO: 636)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR*/GGGGSGGGGS/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Chain 3 - Numax_LC (SEQ ID NO: 637)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

XENP31274 Numax_Fab-huIL10.105_huIL10.105_(G4S)2-IgG1_pI(-)_Isosteric_A_PVA_/S267K/L368D/K370S-IgG1_C220S/PVA_/S267K/S364K/E357Q

Chain 1 - Numax_VH_IgG1_pI(-)_Isosteric_A_PVA_/S267K/L368D/K370S (SEQ ID NO: 638)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - huIL10.105_huIL10.105_(G4S)2_IgG1_C220S/PVA_/S267K/S364K/E357Q (SEQ ID NO: 639)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFNIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR*/GGGGSGGGGS/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Chain 3 - Numax_LC (SEQ ID NO: 640)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 91B

XENP31275 Numax_Fab-empty_Fc-IgG1_pI(-)_Isosteric_A_PVA_/S267K/L368D/K370S-Fc(216)_IgG1_C220S/PVA_/S267K/S364K/E357Q/K447del_(G4S)3_huIL10.102_huIL10.102

Chain 1 - Numax_VH_pI(-)_Isosteric_A_PVA_/S267K/L368D/K370S (SEQ ID NO: 641)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - empty_Fc_Fc(216)_IgG1_C220S/PVA_/S267K/S364K/E357Q/K447del_(G4S)3_huIL10.102_huIL10.102 (SEQ ID NO: 642)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
GGGGSGGGGSGGGGS/SPGQGTQSENSCTHFPGNLPNMLRDLRDAFSRVKTFFQMKDQLDDLLLKESLLEDFKGYLG
CQALSEMIQFYLEEVMPQAENQDPDIKAHVNSLGENLKTLRLRLRRCHRFLPCENKSKAVEQVKNAFNKLQEKGIYK
AMSEFDIFINYIEAYMTMKIRNSPGQGTQSENSCTHFPGNLPNMLRDLRDAFSRVKTFFQMKDQLDDLLLKESLLED
FKGYLGCQALSEMIQFYLEEVMPQAENQDPDIKAHVNSLGENLKTLRLRLRRCHRFLPCENKSKAVEQVKNAFNKLQ
EKGIYKAMSEFDIFINYIEAYMTMKIRN

Chain 3 - Numax_LC (SEQ ID NO: 643)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

XENP31276 Numax_Fab-empty_Fc-IgG1_pI(-)_Isosteric_A_PVA_/S267K/L368D/K370S-Fc(216)_IgG1_C220S/PVA_/S267K/S364K/E357Q/K447del_(G4S)3_huIL10.105_huIL10.105

Chain 1 - Numax_VH_pI(-)_Isosteric_A_PVA_/S267K/L368D/K370S (SEQ ID NO: 644)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - empty_Fc_Fc(216)_IgG1_C220S/PVA_/S267K/S364K/E357Q/K447del_(G4S)3_huIL10.105_huIL10.105 (SEQ ID NO: 645)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
GGGGSGGGGSGGGGS/SPGQGTQSENSCTHFPGNLPNMLRDLRDAFSRVKTFFQMKDQLDDLLLKESLLEDFKGYLG
CQALSEMIQFYLEEVMPQAENQDPDIKAHVNSLGENLKTLRLRLRRCHRFLPCENKSKAVEQVKNAFNKLQEKGIYK
AMSEFDIFINYIEAYMTMKIRNSPGQGTQSENSCTHFPGNLPNMLRDLRDAFSRVKTFFQMKDQLDDLLLKESLLED
FKGYLGCQALSEMIQFYLEEVMPQAENQDPDIKAHVNSLGENLKTLRLRLRRCHRFLPCENKSKAVEQVKNAFNKLQ
EKGIYKAMSEFDIFINYIEAYMTMKIRN

Chain 3 - Numax_LC (SEQ ID NO: 646)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 92

OKT8_H2 Variable Heavy Domain (SEQ ID NO: 647)
QVQLVQSGAEVKKPGASVKVSCKASGFNIKDTYIHWVRQAPGKGLEWMGRIDPANDNTLYASKFQGRVTITADTSIN
TAYMELSRLRSDDTAVYYCGRGYGYYVFDHWGQGTTVTVSS

OKT8_L1 Variable Light Domain (SEQ ID NO: 648)
DIKMTQSPSSLSASVGDRVTITCRTSRSISQYLAWYQEKPGKTNKLLIYSGSTLQSGIPSRFSGSGSGTDFTLTISS
LQPEDFATYYCQQHNENPLTFGAGTKLEIK

1C11B3{CD8}_H1 Variable Heavy Domain (SEQ ID NO: 649)
EVQLLESGGGLVQPGGSLRLSCAASGFTFGSYAMSWVRQAPGKGLEWVSTITASGGTTFYADSVKGRFTISRDNSKN
TLYLQMNSLRAEDTAVYYCAKDADGYGAIAFDYWGQGTLVTVSS

1C11B3{CD8}_L1 Variable Light Domain (SEQ ID NO: 650)
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK

Figure 93A

MS[NKG2D] H0 Variable Heavy Domain (SEQ ID NO: 651)
QVHLQESGPGLVKPSETLSLTCTVSDDSISSYYWSWIRQPPGKGLEWIGHISYSGSANYNPSLKSRVTISVDTSKNQ
FSLKLSSVTAADTAVYYCANWDDAFNIWGQGTMVTVSS

MS[NKG2D] L0 Variable Light Domain (SEQ ID NO: 652)
EIVLTQSPGTLSLSPGERATLSCRASQSVSSSYLAWYQQKPGQAPRLLIYGASSRATGIPDRFSGSGSGTDFTLTIS
RLEPEDFAVYYCQQYGSSPWTFGQGTKVEIK

1D7B4[NKG2D]_H1 Variable Heavy (SEQ ID NO: 653)
EVQLLESGGGLVQPGGSLRLSCAASGFTFSSYAMSWVRQAPGKGLEWVSSISASGGSTYYADSVKGRFTISRDNSKN
TLYLQMNSLRAEDTAVYYCAKGIFSIYFFYFDYWGQGTLVTVSS

1D7B4[NKG2D]_L1 Variable Light (SEQ ID NO: 654)
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK

KYK-1.0[NKG2D]_H1 Variable Heavy (SEQ ID NO: 655)
EVQLVESGGGVVQPGGSLRLSCAASGFTFSSYGMHWVRQAPGKGLEWVAFIRYDGSNKYYADSVKGRFTISRDNSKN
TKYLQMNSLRAEDTAVYYCAKDRFGYYLDYWGQGTLVTVSS

KYK-1.0[NKG2D]_L1 Variable Light (SEQ ID NO: 656)
QPVLTQPSSVSVAPGETARIPCGGDDIETKSVHWYQQKPGQAPVLVIYDDDDRPSGIPERFFGSNSGNTATLSISRV
EAGDEADYYCQVWDDNNDEWVFGGGTQLTVL

KYK-2.0[NKG2D]_H0 Variable Heavy (SEQ ID NO: 657)
QVQLVESGGGLVKPGGSLRLSCAASGFTFSSYGMHWVRQAPGKGLEWVAFIRYDGSNKYYADSVKGRFTISRDNSKN
TKYLQMNSLRAEDTAVYYCAKDRGLGDGTYFDYWGQGTTVTVSS

KYK-2.0[NKG2D]_L0 Variable Light (SEQ ID NO: 658)
QSALTQPASVSGSPGQSITISCSGSSSNIGNNAVNWYQQLPGKAPKLLIYYDDLLPSGVSDRFSGSKSGTSAFLAIS
GLQSEDEADYYCAAWDDSLNGPVFGGGTKLTVL

11B2D10[NKG2D]_H0 Variable Heavy (SEQ ID NO: 659)
QVQLQQSGPELVRPGASVKLSCKASGYTFTSYWMNWVQQRPEQGLEWIGRIDPYDSETHYNQKFKDKAILTVDKSAS
TAYMQLSSLTSEDSAVYYCAKMGDYSFDYWGQGTTVTVSS

11B2D10[NKG2D]_L0 Variable Light (SEQ ID NO: 660)
DIQLTQSPASLSASVGETVTITCRASGNIHNYLAWYQQKQGKSPQVLVYNAKTLADGVPSRFSGSGSGTQYSLKINS
LQPEDFGSYYCQHFWSTTWTFGGGTKLEIK

6E5A7[NKG2D]_H0 Variable Heavy (SEQ ID NO: 661)
QVQLQQSGPGLVQPSQSLSITCTVSGFSLTIYGVHWVRQSPGKGLEWLGVIWSGGSTDYNAAFISRLSISKDNSKRQ
VFFKMSSLQANDTAIYYCSRKSHDGYYGVMDYWGQGTTVTVSS

6E5A7[NKG2D]_L0 Variable Light (SEQ ID NO: 662)
DIQLTQSPAILSVSPGERVSFSCRASQSIGTSIHWYQQRTNGSPRLLIKYASESISGIPSRFSGSGSGTDFTLSING
VESEDIADYYCQQSNTWPLTFGAGTKLEIK

Figure 93B

6H7E7[NKG2D]_H0 Variable Heavy (SEQ ID NO: 663)
QVQLQESGPGLVAPSQSLSITCTVSGFSLTSYGVHWIRQPPGKGLEWLGVIWAGGSTNYNSALMSRLSISKDNSKSQ
VFLKMNSLQIDDTAMYYCARGGYEGAAWFGYWGQGTTVTVSS

6H7E7[NKG2D]_L0 Variable Light (SEQ ID NO: 664)
DIQLTQSPAILSASPGEKVTMTCRASSSVSYMHWYQQKPGSSPKPWIYATSNLASGVPARFSGSGSGTSYSLTISRV
EAEDAATYYCQQWNSNPLTFGAGTKLEIK mAb E[NKG2D]_H1 Variable Heavy (SEQ ID NO: 665)
EVQLVESGGGLVKPGGSLRLSCAASGFTFSSYSMNWVRQAPGKGLEWVSSITSSSSYIYYADSVKGRFTISRDNAKN
SLYLQMNSLRAEDTAVYYCARDRRYFDWFPLDYRGQGTLVTVSS mAb E[NKG2D]_L1 Variable Light (SEQ ID NO: 666)
DIQMTQSPSSLSASVGDRVTITCRASQGISSWLAWYQQKPEKAPKSLIYAASSLQSGVPSRFSGSGSGTDFTLTISS
LQPEDFATYYCQQYNGYPYTFGQGTKLEIK

16F31[NKG2D]_H1 Variable Heavy (SEQ ID NO: 667)
EVQLVESGGGVVRPGGSLRLSCAASGFTFDDYGMTWVRQAPGKGLEWVSGINWNGGSTGYADSVKGRFTISRDNAKN
SLYLQMNSLRAEDTALYYCARERELYYYYYGLDVWGQGTTVTVSS

16F31[NKG2D]_L1 Variable Light (SEQ ID NO: 668)
EIVLTQSPGTLSLSPGERATLSCRASQSVSSSYLAWYQQKPGQAPRLLIYGASSRATGIPDRFSGSGSGTDFTLTIS
RLEPEDFAVYYCQQYGSSPFTFGPGTKVDIKR mAb D[NKG2D]_H1 Variable Heavy (SEQ ID NO: 669)
QVQLVQSGAEVKKPGASVKVSCKASGYTFTNYWMHWVRQAPGQGLEWMGEIDPSDIYTNYAQKFQGRVTMTRDTSTS
TVYMELSSLRSEDTAVYYCARGIYDGYYVYGMDYWGQGTTVTVSS mAb D[NKG2D]_L1 Variable Light (SEQ ID NO: 670)
YIQMTQSPSSLSASVGDRVTITCRSSQDISNYLNWYQQKPGKAPKLLIYYTSRLHSGVPSRFSGSGSGTDFTFTISS
LQPEDIATYYCQQGKTLPRTFGGGTKVEIK

1D7B4[NKG2D]_H1 Variable Heavy (SEQ ID NO: 671)
EVQLLESGGGLVQPGGSLRLSCAASGFTFSSYAMSWVRQAPGKGLEWVSSISASGGSTYYADSVKGRFTISRDNSKN
TLYLQMNSLRAEDTAVYYCAKGIFSIYFFYFDYWGQGTLVTVSS

1D7B4[NKG2D]_L1 Variable Light (SEQ ID NO: 672)
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK mAb A[NKG2D]_H1 Variable Heavy (SEQ ID NO: 673)
QVQLVQSGAEVKKPGASVKVSCKVSGFSLTSYGVHWIRQAPGQGLEWMGVIWAGGSTNYNSKFQGRVTMTKDNSKST
VYMELSSLRSEDTAVYYCARGGYEGAAWFGYWGQGTLVTVSS mAb A[NKG2D]_H2 Variable Heavy (SEQ ID NO: 674)
QVQLQESGPGLVKPSETLSLTCTVSGFSLTSYGVHWIRQPPGKGLEWIGVIWAGGSTNYNPSLKSRVTISKDNSKSQ
VSLKLSSVTAADTAVYYCARGGYEGAAWFGYWGQGTLVTVSS

Figure 93C mAb A[NKG2D]_L1 Variable Light (SEQ ID NO: 675)
DIQLTQSPSSLSASVGDRVTITCRASSSVSYMHWYQQKPGKSPKPLIYATSNLASGVPARFSGSGSGTDYTLTISSL
QPEDFATYYCQQWNSNPLTFGAGTKVEIK mAb A[NKG2D]_L2 Variable Light (SEQ ID NO: 676)
DIQLTQSPATLSLSPGERATLSCRASSSVSYMHWYQQKPGQSPRPLIYATSNLASGVPARFSGSGSGTDYTLTISSL
EPEDFAVYYCQQWNSNPLTFGAGTKVEIK mAb B[NKG2D]_H1 Variable Heavy (SEQ ID NO: 677)
QVQLVQSGAEVKKPGASVKVSCKASGYTFTSYWMNWVRQAPGQGLEWMGRIDPYDSETHYNQKFQGRVTMTVDKSTS
TAYMELSSLRSEDTAVYYCAKMGDYSFDYWGQGTLVTVSS mAb B[NKG2D]_H2 Variable Heavy (SEQ ID NO: 678)
EVQLVQSGAEVKKPGESLRISCKASGYTFTSYWMNWVRQMPGKGLEWMGRIDPYDSETHYNPSFQGHVTISVDKSIS
TAYLQWSSLKASDTAMYYCAKMGDYSFDYWGQGTLVTVSS mAb B[NKG2D]_H3 Variable Heavy (SEQ ID NO: 679)
EVQLVESGGGLVQPGGSLRLSCAASGYTFTSYWMNWVRQAPGKGLVWVSRIDPYDSETHYNQKVKGRFTISVDKAKS
TAYLQMNSLRAEDTAVYYCAKMGDYSFDYWGQGTLVTVSS mAb B[NKG2D]_L1 Variable Light (SEQ ID NO: 680)
DIQLTQSPSSLSASVGDRVTITCRASGNIHNYLAWYQQKPGKSPKVLVYNAKTLADGVPSRFSGSGSGTDYTLTISS
LQPEDFATYYCQHFWSTTWTFGGGTKVEIK mAb B[NKG2D]_L1.1 Variable Light (SEQ ID NO: 681)
DIQLTQSPSSLSASVGDRVTITCRASGNIHNYLAWYQQKPGKSPKVLVYNAKTLADGVPSRFSGSGSGTDYTLTISS
LQPEDFATYYCQHFWSTPWTFGGGTKVEIK mAb B[NKG2D]_L2 Variable Light (SEQ ID NO: 682)
DIQLTQSPDSLAVSLGERATINCKASGNIHNYLAWYQQKPGQSPKVLVYNAKTLADGVPSRFSGSGSGTDYTLTISS
LQAEDVAVYYCQHFWSTTWTFGGGTKVEIK mAb C[NKG2D]_H1 Variable Heavy (SEQ ID NO: 683)
EVQLVESGGGLVQPGGSLRLSCAVSGFSLTIYGVHWVRQAPGKGLEWVSVIWSGGSTDYNAKVKGRFTISKDNSKRT
VYLQMNSLRAEDTAVYYCSRKSHDGYYGVMDYWGQGTTVTVSS mAb C[NKG2D]_H2 Variable Heavy (SEQ ID NO: 684)
QVQLVQSGAEVKKPGASVKVSCKVSGFSLTIYGVHWVRQAPGQGLEWMGVIWSGGSTDYNAKFQGRVTMTKDNSKRT
VYMELSSLRSEDTAVYYCSRKSHDGYYGVMDYWGQGTTVTVSS mAb C[NKG2D]_L1 Variable Light (SEQ ID NO: 685)
DIQLTQSPDFQSVTPKEKVTITCRASQSIGTSIHWYQQKPDQSPKLLIKYASESISGIPSRFSGSGSGTDFTLTINS
LEAEDAATYYCQQSNTWPLTFGAGTKVEIK mAb C[NKG2D]_L2 Variable Light (SEQ ID NO: 686)
DIQLTQSPSSLSASVGDRVTITCRASQSIGTSIHWYQQKPGKSPKLLIKYASESISGIPSRFSGSGSGTDFTLTISS
LQPEDFATYYCQQSNTWPLTFGAGTKVEIK

Figure 94

>XENP25365 OKT8_H2L1_Fab-huIL10M1_Fc(216)_IgG1_PVA_/S267K_pI(-)_Isosteric_A_L368D/K370S-IgG1_C220S/S364K/E357Q

XENP25365 Chain 1 - OKT8_H2_IgG1_PVA_/S267K_pI(-)_Isosteric_A_L368D/K370S HC (SEQ ID NO: 687)
QVQLVQSGAEVKKPGASVKVSCKASGFNIK<u>DTYIH</u>WVRQAPGKGLEWMG<u>RIDPANDNTLYASKFQG</u>RVTITADTSIN
TAYMELSRLRSDDTAVYYCGR<u>GYGYYVFDH</u>WGQGTTVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

XENP25365 Chain 2 - huIL10M1_Fc(216)_IgG1_C220S/S364K/E357Q (SEQ ID NO: 688)
*SPGQGTQSENSCTHFPGNLPNMLRDLRDAFSRVKTFFQMKDQLDNLLLKESLLEDFKGYLGCQALSEMIQFYLEEVM*
*PQAENQDPDIKAHVNSLGENLKTLRLRLRRCHRFLPCENGGGSGGKSKAVEQVKNAFNKLQEKGIYKAMSEFDIFIN*
*YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

XENP25365 Chain 3 - OKT8_L1 LC (SEQ ID NO: 689)
DIKMTQSPSSLSASVGDRVTITC<u>RTSRSISQYLA</u>WYQEKPGKTNKLLIY<u>SGSTLQS</u>GIPSRFSGSGSGTDFTLTISS
LQPEDFATYYC<u>QQHNENPLT</u>FGAGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC >XENP25366      1C11B3[CD8]_H1L1_Fab-huIL10M1_Fc(216)_IgG1_PVA_/S267K_pI(-)_Isosteric_A_L368D/K370S-IgG1_C220S/S364K/E357Q

XENP25366 Chain 1 - 1C11B3[CD8]_H1_IgG1_PVA_/S267K_pI(-)_Isosteric_A_L368D/K370S HC (SEQ ID NO: 690)
EVQLLESGGGLVQPGGSLRLSCAASGFTFGS<u>YAMS</u>WVRQAPGKGLEWVS<u>TITASGGTTFYADSVKG</u>RFTISRDNSKN
TLYLQMNSLRAEDTAVYYCAK<u>DADGYGAIAFDY</u>WGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

XENP25366 Chain 2 - huIL10M1_Fc(216)_IgG1_C220S/S364K/E357Q (SEQ ID NO: 691)
*SPGQGTQSENSCTHFPGNLPNMLRDLRDAFSRVKTFFQMKDQLDNLLLKESLLEDFKGYLGCQALSEMIQFYLEEVM*
*PQAENQDPDIKAHVNSLGENLKTLRLRLRRCHRFLPCENGGGSGGKSKAVEQVKNAFNKLQEKGIYKAMSEFDIFIN*
*YIEAYMTMKIRN*/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEALHN
HYTQKSLSLSPGK

XENP25366 Chain 3 - 1C11B3[CD8]_L1 LC (SEQ ID NO: 692)
DIQMTQSPSSLSASVGDRVTITC<u>RASQSISSYLN</u>WYQQKPGKAPKLLIY<u>AASSLQS</u>GVPSRFSGSGSGTDFTLTISS
LQPEDFATYYC<u>QQSYSTPYT</u>FGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 95

>XENP26172 OKT8_H2L1_IgG1_PVA_/S267K_(G4S)3_huIL10M1

XENP26172 Chain 1 - OKT8_H2_IgG1_PVA_/S267K_(G4S)3_huIL10M1 (SEQ ID NO: 693)
QVQLVQSGAEVKKPGASVKVSCKASGFNIKDTYIHWVRQAPGKGLEWMGRIDPANDNTLYASKFQGRVTITADTSIN
TAYMELSRLRSDDTAVYYCGRGYGYYVFDHWGQGTTVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSNTKVDKKVEPKSCDKTHTCPPC
PAPPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREEMTKNQVSLTCLVKGFYPSDIAVEWESN
GQPENNYKTTPPVLDSDGSFFLYSKLTVDKSRWQQGNVFSCSVMHEALHNHYTQKSLSLSPGK/GGGGSGGGGSGGG
GS/SPGQGTQSENSCTHFPGNLPNMLRDLRDAFSRVKTFFQMKDQLDNLLLKESLLEDFKGYLGCQALSEMIQFYLE
EVMPQAENQDPDIKAHVNSLGENLKTLRLRLRRCHRFLPCENGGGSGGKSKAVEQVKNAFNKLQEKGIYKAMSEFDI
FINYIEAYMTMKIRN

XENP26172 Chain 2 - OKT8_L1 LC (SEQ ID NO: 694)
DIKMTQSPSSLSASVGDRVTITCRTSRSISQYLAWYQEKPGKTNKLLIYSGSTLQSGIPSRFSGSGSGTDFTLTISS
LQPEDFATYYCQQHNENPLTFGAGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 96A

<u>>XENP25415 huIL10_huIL10_(G4S)2-OKT8_H2L1_Fab-Fc(216)_pI(-
)_Isosteric_A_C220S/PVA_/S267K/L368D/K370S-IgG1_PVA_/S267K/S364K/E357Q</u>

XENP25415 Chain 1 - huIL10_huIL10_(G4S)2_Fc(216)_pI(-)_Isosteric_A_C220S/PVA_/S267K/L368D/K370S (SEQ ID NO: 695)

*SPGQGTQSENSCTHFPGNLPNMLRDLRDAFSRVKT*FFQMKDQLDNLLLKESLLEDFKGYLGCQALSEMIQFYLEEVMPQAE
NQDPDIKAHVNSLGENLKTLRLRLRRCLRFLPCENKSKAVEQVKNAFNKLQEKGIYKAMSEFDIFINYIEAYMTMKI
RNSPGQGTQSENSCTHFPGNLPNMLRDLRDAFSRVKTFFQMKDQLDNLLLKESLLEDFKGYLGCQALSEMIQFYLEE
VMPQAENQDPDIKAHVNSLGENLKTLRLRLRRCLRFLPCENKSKAVEQVKNAFNKLQEKGIYKAMSEFDIFINYIEA
YMTMKIRN/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQVYT
LPPSREEMTKNQVSLTCDVSGFYPSDIAVEWESDGQPENNYKTTPPVLDSDGSFFLYSKLTVDKSRWEQGDVFSCSV
MHEALHNHYTQKSLSLSPGK

XENP25415 Chain 2 - OKT8_H2_IgG1_PVA_/S267K/S364K/E357Q HC (SEQ ID NO: 696)

QVQLVQSGAEVKKPGASVKVSCKASGFNIK<u>DTYIH</u>WVRQAPGKGLEWMG<u>RIDPANDNTLYASKFQG</u>RVTITADTSIN
TAYMELSRLRSDDTAVYYCGR<u>GYGYYVFDH</u>WGQGTTVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSNTKVDKKVEPKSCDKTHTCPPC
PAPPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWESN
GQPENNYKTTPPVLDSDGSFFLYSKLTVDKSRWQQGNVFSCSVMHEALHNHYTQKSLSLSPGK

XENP25415 Chain 3 - OKT8_L1 LC (SEQ ID NO: 697)

DIKMTQSPSSLSASVGDRVTITC<u>RTSRSISQYLA</u>WYQEKPGKTNKLLIY<u>SGSTLQS</u>GIPSRFSGSGSGTDFTLTISS
LQPEDFATYYC<u>QQHNENPLT</u>FGAGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

<u>>XENP25791 OKT8_H2L1_Fab-huIL10_huIL10_(G4S)2-Fc(216)_IgG1_PVA_/S267K_pI(-
)_Isosteric_A_L368D/K370S-IgG1_C220S/S364K/E357Q</u>

XENP25791 Chain 1 - OKT8_H2_IgG1_PVA_/S267K_pI(-)_Isosteric_A_L368D/K370S (SEQ ID NO: 698)

QVQLVQSGAEVKKPGASVKVSCKASGFNIK<u>DTYIH</u>WVRQAPGKGLEWMG<u>RIDPANDNTLYASKFQG</u>RVTITADTSIN
TAYMELSRLRSDDTAVYYCGR<u>GYGYYVFDH</u>WGQGTTVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

XENP25791 Chain 2 - huIL10_huIL10_(G4S)2-Fc(216)_IgG1_C220S/S364K/E357Q (SEQ ID NO: 699)

*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN*/<u>GGGGSGGGGS</u>/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Figure 96B

XENP25791 Chain 3 - OKT8_L1 LC (SEQ ID NO: 700)
DIKMTQSPSSLSASVGDRVTITCRTSRSISQYLAWYQEKPGKTNKLLIYSGSTLQSGIPSRFSGSGSGTDFTLTISS
LQPEDFATYYCQQHNENPLTFGAGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP25794 OKT8_H2L1_Fab-huIL10_(G4S)3_huIL10_(G4S)2-Fc(216)_IgG1_PVA_/S267K_pI(-)_Isosteric_A_L368D/K370S-IgG1_C220S/S364K/E357Q

XENP25794 Chain 1 - OKT8_H2_IgG1_PVA_/S267K_pI(-)_Isosteric_A_L368D/K370S HC (SEQ ID NO: 701)
QVQLVQSGAEVKKPGASVKVSCKASGFNIKDTYIHWVRQAPGKGLEWMGRIDPANDNTLYASKFQGRVTITADTSIN
TAYMELSRLRSDDTAVYYCGRGYGYYVFDHWGQGTTVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

XENP25794 Chain 2 - huIL10_(G4S)3_huIL10_(G4S)2-Fc(216)_IgG1_C220S/S364K/E357Q (SEQ ID NO: 702)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRN*/GGGGSGGGGSGGGGS/*SPGQGTQSENSCTHFPGNLPNMLRDLRDAFSRVKTFFQMKDQLDNLLLKESLLE
DFKGYLGCQALSEMIQFYLEEVMPQAENQDPDIKAHVNSLGENLKTLRLRLRRCLRFLPCENKSKAVEQVKNAFNKL
QEKGIYKAMSEFDIFINYIEAYMTMKIRN*/GGGGSGGGGS/EPKSSDKTHTCPPCPAPPVAGPSVFLFPPKPKDTLM
ISRTPEVTCVVVDVKHEDPEVKFNWYVDGVEVHNAKTKPREEQYNSTYRVVSVLTVLHQDWLNGKEYKCKVSNKALP
APIEKTISKAKGQPREPQVYTLPPSREQMTKNQVKLTCLVKGFYPSDIAVEWESNGQPENNYKTTPPVLDSDGSFFL
YSKLTVDKSRWQQGNVFSCSVMHEALHNHYTQKSLSLSPGK

XENP25794 Chain 3 - OKT8_L1 LC (SEQ ID NO: 703)
DIKMTQSPSSLSASVGDRVTITCRTSRSISQYLAWYQEKPGKTNKLLIYSGSTLQSGIPSRFSGSGSGTDFTLTISS
LQPEDFATYYCQQHNENPLTFGAGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 96C

>XENP26879          OKT8_H2L1_Fab-huIL10_huIL10_(G4S)2-IgG1_pI(-)_Isosteric_A_PVA_/S267K/L368D/K370S-Fc(216)_IgG1_PVA_/S267K/S364K/E357Q

XENP26879 Chain 1 - OKT8_H2_IgG1_pI(-)_Isosteric_A_PVA_/S267K/L368D/K370S (SEQ ID NO: 704)
QVQLVQSGAEVKKPGASVKVSCKASGFNIKDTYIHWVRQAPGKGLEWMGRIDPANDNTLYASKFQGRVTITADTSIN
TAYMELSRLRSDDTAVYYCGRGYGYYVFDHWGQGTTVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

XENP26879 Chain 2 - huIL10_huIL10_(G4S)2_Fc(216)_IgG1_PVA_/S267K/S364K/E357Q (SEQ ID NO: 705)
SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN/GGGGSGGGGS/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

XENP26879 Chain 3 - OKT8_L1 LC (SEQ ID NO: 706)
DIKMTQSPSSLSASVGDRVTITCRTSRSISQYLAWYQEKPGKTNKLLIYSGSTLQSGIPSRFSGSGSGTDFTLTISS
LQPEDFATYYCQQHNENPLTFGAGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 97A

>XENP25952 MS_H0L0_Fab-huIL10_huIL10_(G4S)2-Fc(216)_IgG1_PVA_/S267K_pI(-)_Isosteric_A_L368D/K370S-IgG1_C220S/S364K/E357Q (same as XENP27227)

XENP25952 Chain 1 - MS_H0_IgG1_PVA_/S267K_pI(-)_Isosteric_A_L368D/K370S HC (SEQ ID NO: 707)
QVHLQESGPGLVKPSETLSLTCTVSDDSISSYYWSWIRQPPGKGLEWIGHISYSGSANYNPSLKSRVTISVDTSKNQ
FSLKLSSVTAADTAVYYCANWDDAFNIWGQGTMVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK

XENP25952 Chain 2 - huIL10_huIL10_(G4S)2-Fc(216)_IgG1_C220S/S364K/E357Q (SEQ ID NO: 708)
*SPGQGTQSENSCTHFPGNLPNMLRDLRDAFSRVKTFFQMKDQLDNLLLKESLLEDFKGYLGCQALSEMIQFYLEEVM*
*PQAENQDPDIKAHVNSLGENLKTLRLRLRRCLRFLPCENKSKAVEQVKNAFNKLQEKGIYKAMSEFDIFINYIEAYM*
*TMKIRNSPGQGTQSENSCTHFPGNLPNMLRDLRDAFSRVKTFFQMKDQLDNLLLKESLLEDFKGYLGCQALSEMIQF*
*YLEEVMPQAENQDPDIKAHVNSLGENLKTLRLRLRRCLRFLPCENKSKAVEQVKNAFNKLQEKGIYKAMSEFDIFIN*
*YIEAYMTMKIRN*/GGGGSGGGGS/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

XENP25952 Chain 3 - MS_L0 LC (SEQ ID NO: 709)
EIVLTQSPGTLSLSPGERATLSCRASQSVSSSYLAWYQQKPGQAPRLLIYGASSRATGIPDRFSGSGSGTDFTLTIS
RLEPEDFAVYYCQQYGSSPWTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

XENP30526 MS[NKG2D]_H0L0_Fab-huIL10.104_huIL10.104_(G4S)2-IgG1_pI(-)_Isosteric_A_PVA_/S267K/L368D/K370S-IgG1_C220S/PVA_/S267K/S364K/E357Q

Chain 1 - MS[NKG2D]_H0_IgG1_pI(-)_Isosteric_A_PVA_/S267K/L368D/K370S (SEQ ID NO: 710)
QVHLQESGPGLVKPSETLSLTCTVSDDSISSYYWSWIRQPPGKGLEWIGHISYSGSANYNPSLKSRVTISVDTSKNQ
FSLKLSSVTAADTAVYYCANWDDAFNIWGQGTMVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK

Chain 2 - huIL10.104_huIL10.104_(G4S)2_IgG1_C220S/PVA_/S267K/S364K/E357Q (SEQ ID NO: 711)
*SPGQGTQSENSCTHFPGNLPNMLRDLRDAFSRVKTFFQMKNQLDDLLLKESLLEDFKGYLGCQALSEMIQFYLEEVM*
*PQAENQDPDIKAHVNSLGENLKTLRLRLRRCHRFLPCENKSKAVEQVKNAFNKLQEKGIYKAMSEFDIFINYIEAYM*
*TMKIRNSPGQGTQSENSCTHFPGNLPNMLRDLRDAFSRVKTFFQMKDQLDDLLLKESLLEDFKGYLGCQALSEMIQF*
*YLEEVMPQAENQDPDIKAHVNSLGENLKTLRLRLRRCHRFLPCENKSKAVEQVKNAFNKLQEKGIYKAMSEFDIFIN*
*YIEAYMTMKIR*/GGGGSGGGGS/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Figure 97B

Chain 3 - MS[NKG2D]_L0 (SEQ ID NO: 712)
EIVLTQSPGTLSLSPGERATLSCRASQSVSSSYLAWYQQKPGQAPRLLIYGASSRATGIPDRFSGSGSGTDFTLTIS
RLEPEDFAVYYCQQYGSSPWTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

XENP30527 MS[NKG2D]_H0L0_Fab-huIL10.105_huIL10.105_(G4S)2-IgG1_pI(-
)_Isosteric_A_PVA_/S267K/L368D/K370S-IgG1_C220S/PVA_/S267K/S364K/E357Q

Chain 1 - MS[NKG2D]_H0_IgG1_pI(-)_Isosteric_A_PVA_/S267K/L368D/K370S (SEQ ID NO: 713)
QVHLQESGPGLVKPSETLSLTCTVSDDSISSYYWSWIRQPPGKGLEWIGHISYSGSANYNPSLKSRVTISVDTSKNQ
FSLKLSSVTAADTAVYYCANWDDAFNIWGQGTMVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK

Chain 2 - huIL10.105_huIL10.105_(G4S)2_IgG1_C220S/PVA_/S267K/S364K/E357Q (SEQ ID NO: 714)
*SPGQGTQSENSCTHFPGNLPNMLRDLRDAFSRVKTFFQMKDQLDDLLLKESLLEDFKGYLGCQALSEMIQFYLEEVM*
*PQAENQDPDIKAHVNSLGENLKTLRLRLRRCHRFLPCENKSKAVEQVKNAFNKLQEKGIYKAMSEFNIFINYIEAYM*
*TMKIRNSPGQGTQSENSCTHFPGNLPNMLRDLRDAFSRVKTFFQMKDQLDDLLLKESLLEDFKGYLGCQALSEMIQF*
*YLEEVMPQAENQDPDIKAHVNSLGENLKTLRLRLRRCHRFLPCENKSKAVEQVKNAFNKLQEKGIYKAMSEFDIFIN*
*YIEAYMTMKIR*/GGGGSGGGGS/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Chain 3 - MS[NKG2D]_L0 (SEQ ID NO: 715)
EIVLTQSPGTLSLSPGERATLSCRASQSVSSSYLAWYQQKPGQAPRLLIYGASSRATGIPDRFSGSGSGTDFTLTIS
RLEPEDFAVYYCQQYGSSPWTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

XENP30528 MS[NKG2D]_H0L0_Fab-huIL10.107_huIL10.107_(G4S)2-IgG1_pI(-
)_Isosteric_A_PVA_/S267K/L368D/K370S-IgG1_C220S/PVA_/S267K/S364K/E357Q

Chain 1 - MS[NKG2D]_H0_IgG1_pI(-)_Isosteric_A_PVA_/S267K/L368D/K370S (SEQ ID NO: 716)
QVHLQESGPGLVKPSETLSLTCTVSDDSISSYYWSWIRQPPGKGLEWIGHISYSGSANYNPSLKSRVTISVDTSKNQ
FSLKLSSVTAADTAVYYCANWDDAFNIWGQGTMVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK

Chain 2 - huIL10.107_huIL10.107_(G4S)2_IgG1_C220S/PVA_/S267K/S364K/E357Q (SEQ ID NO: 717)
*SPGQGTQSENSCTHFPGNLPNMLRDLRDAFSRVKTFFQMKDQLDDLLLKESLLEDFKGYLGCQALSEMIQFYLEEVM*
*PQAENQDPDIKAHVNSLGENLKTLRLRLRRCHRFLPCENKSKAVEQVKNAFNKLQEKGIYKAMSEFDIFINYIEAYM*
*TMKIRNSPGQGTQSENSCTHFPGNLPDMLRDLRDAFSRVKTFFQMKDQLDDLLLKESLLEDFKGYLGCQALSEMIQF*
*YLEEVMPQAENQDPDIKAHVNSLGENLKTLRLRLRRCHRFLPCENKSKAVEQVKNAFNKLQEKGIYKAMSEFDIFIN*
*YIEAYMTMKIR*/GGGGSGGGGS/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Figure 97C

Chain 3 - MS[NKG2D]_L0 (SEQ ID NO: 718)
EIVLTQSPGTLSLSPGERATLSCRASQSVSSSYLAWYQQKPGQAPRLLIYGASSRATGIPDRFSGSGSGTDFTLTIS
RLEPEDFAVYYCQQYGSSPWTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

**XENP31819 MS[NKG2D]_H0L0_Fab-huIL10.102_huIL10.102_(G4S)2-IgG1_pI(-
)_Isosteric_A_PVA_/S267K/L368D/K370S-IgG1_C220S/PVA_/S267K/S364K/E357Q**

Chain 1 - MS[NKG2D]_H0_IgG1_pI(-)_Isosteric_A_PVA_/S267K/L368D/K370S (SEQ ID NO: 719)
QVHLQESGPGLVKPSETLSLTCTVSDDSISSYYWSWIRQPPGKGLEWIGHISYSGSANYNPSLKSRVTISVDTSKNQ
FSLKLSSVTAADTAVYYCANWDDAFNIWGQGTMVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK

Chain 2 - huIL10.102_huIL10.102_(G4S)2_IgG1_C220S/PVA_/S267K/S364K/E357Q (SEQ ID NO: 720)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR*/GGGGSGGGGS/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Chain 3 - MS[NKG2D]_L0 (SEQ ID NO: 721)
EIVLTQSPGTLSLSPGERATLSCRASQSVSSSYLAWYQQKPGQAPRLLIYGASSRATGIPDRFSGSGSGTDFTLTIS
RLEPEDFAVYYCQQYGSSPWTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

Figure 98

>XENP26883 OKT8_H2L1_Fab-huIL10.38_huIL10.38_(G4S)2-IgG1_pI(-)_Isosteric_A_PVA_/S267K/L368D/K370S-Fc(216)_IgG1_PVA_/S267K/S364K/E357Q

XENP26883 Chain 1 - OKT8_H2_IgG1_pI(-)_Isosteric_A_PVA_/S267K/L368D/K370S HC (SEQ ID NO: 722)
QVQLVQSGAEVKKPGASVKVSCKASGFNIKDTYIHWVRQAPGKGLEWMGRIDPANDNTLYASKFQGRVTITADTSIN
TAYMELSRLRSDDTAVYYCGRGYGYYVFDHWGQGTTVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

XENP26883 Chain 2 - huIL10.38_huIL10.38_(G4S)2_Fc(216)_IgG1_PVA_/S267K/S364K/E357Q (SEQ ID NO: 723)
*SPGQGTQSENSCTHFPGNLPNMLRDLRDAFSRVKTFFEMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFEMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN/GGGGSGGGGS*/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

XENP26883 Chain 3 - OKT8_L1 LC (SEQ ID NO: 724)
DIKMTQSPSSLSASVGDRVTITCRTSRSISQYLAWYQEKPGKTNKLLIYSGSTLQSGIPSRFSGSGSGTDFTLTISS
LQPEDFATYYCQQHNENPLTFGAGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 100A

>1C11[PD-1]_H0L0 Variable Heavy Chain (SEQ ID NO: 725)
QIQLVQSGPELKKPGETVKISCRASGYTFTHYGMNWVKQAPGKGLKWMGWINTYTGEPTYADDFKGRFAFSLETSASTAYLQINNLKNEDTAT
YFCARDYYGSSPYWGQGTTLTVSS >1C11[PD-1]_H0L0 Variable Light Chain (SEQ ID NO: 726)
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYC
FQGSHVPNTFGGGTKLEIK >1C11[PD-1]_H3L3 Variable Heavy Chain (SEQ ID NO: 727)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS >1C11[PD-1]_H3L3 Variable Light Chain (SEQ ID NO: 728)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK >1C11[PD-1]_H3.240_L3.148 Variable Heavy Chain (SEQ ID NO: 729)
QVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS >1C11[PD-1]_H3.240_L3.148 Variable Light Chain (SEQ ID NO: 730)
DIVMTQSPDSLAVSLGERVTINCKASQSIVHSNGNTYLEWYQQKPGQAPKLLIYKVSNRFSGVPDRFSGSGSGTDFT
LTISSVEAEDAATYYCFQGSHVPNTFGQGTKVEIK >1C11[PD-1]_H3.241_L3.148 Variable Heavy Chain (SEQ ID NO: 731)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS >1C11[PD-1]_H3.241_L3.148 Variable Light Chain (SEQ ID NO: 732)
DIVMTQSPDSLAVSLGERVTINCKASQSIVHSNGNTYLEWYQQKPGQAPKLLIYKVSNRFSGVPDRFSGSGSGTDFT
LTISSVEAEDAATYYCFQGSHVPNTFGQGTKVEIK >1C11[PD-1]_H3.234_L3.144 Variable Heavy Chain (SEQ ID NO: 733)
EVQLVQSGSELKKPGESVKVSCKASGYTFTHYGINWVRQPPGQGLEWMGWINTYTGEPYYAPGFQERFVFSLDTSQD
TAYLQINSLKAEDTAVYYCARDYYGSSPYWGQGTLVTVSS >1C11[PD-1]_H3.234_L3.144 Variable Light Chain (SEQ ID NO: 734)
DIVMTQSPDSLAVSLGERVTINCKASQSIVHSNGNTYLEWYQQKPGQPPKLLIYKVSNRFSGVPDRFSGSGSGTDFT
LTISSVEAEDAATYYCFQGSHVPNTFGQGTKVEIK >1C11[PD-1]_H3.241_L3.92 Variable Heavy Chain (SEQ ID NO: 735)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS >1C11[PD-1]_H3.241_L3.92 Variable Light Chain (SEQ ID NO: 736)
DIVMTQSPDSLAVSLGERVTINCKASQSIVHSNGNTYLEWYQQKPGQPPKLLIYKVSNRFTGVPDRFSGSGSGTDFT
LTISSLQAEDVAVYYCFQGSHVPNTFGGGTKVEIK >1C11[PD-1]_H3.303_L3.152 Variable Heavy Chain (SEQ ID NO: 737)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYFGSSPYWGQGTLVTVSS >1C11[PD-1]_H3.303_L3.152 Variable Light Chain (SEQ ID NO: 738)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK

Figure 100B

\>1C11_H3.329_L3.220 Variable Heavy Chain (SEQ ID NO: 739)
QIQLVQSGSELLKPGASVSVSCKASGYTFTHYGMNWVRQAPGQGLEWMGWINTHTGEPTYADGFTGRFVFSLDTSVS
TAYLQISSLKAEDTAVYFCARDYFGSSPYWGQGTLVTVSS \>1C11_H3.329_L3.220 Variable Light Chain (SEQ ID NO: 740)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK \>1C11_H3.328_L3.152 Variable Heavy Chain (SEQ ID NO: 741)
QIQLVQSGSELKKPGASVSVSCKASGYTFTHYGMNWVRQAPGQGLEWMGWINTHTGEPTYADGFTGRFVFSLDTSVS
TAYLQISSLKAEDTAVYFCARDYFGSSPYWGQGTLVTVSS \>1C11_H3.328_L3.152 Variable Light Chain (SEQ ID NO: 742)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK \>pembrolizumab[PD-1] variable heavy Chain (SEQ ID NO: 743)
QVQLVQSGVEVKKPGASVKVSCKASGYTFTNYYMYWVRQAPGQGLEWMGGINPSNGGTNFNEKFKNRVTLTTDSSTT
TAYMELKSLQFDDTAVYYCARRDYRFDMGFDYWGQGTTVTVSS \>pembrolizumab[PD-1] variable light Chain (SEQ ID NO: 744)
EIVLTQSPATLSLSPGERATLSCRASKGVSTSGYSYLHWYQQKPGQAPRLLIYLASYLESGVPARFSGSGSGTDFTL
TISSLEPEDFAVYYCQHSRDLPLTFGGGTKVEIK \>nivolumab[PD-1] variable heavy Chain (SEQ ID NO: 745)
QVQLVESGGGVVQPGRSLRLDCKASGITFSNSGMHWVRQAPGKGLEWVAVIWYDGSKRYYADSVKGRFTISRDNSKN
TLFLQMNSLRAEDTAVYYCATNDDYWGQGTLVTVSS \>nivolumab[PD-1] variable light Chain (SEQ ID NO: 746)
EIVLTQSPATLSLSPGERATLSCRASQSVSSYLAWYQQKPGQAPRLLIYDASNRATGIPARFSGSGSGTDFTLTISS
LEPEDFAVYYCQQSSNWPRTFGQGTKVEIK \>pidilizumab[PD-1] variable heavy Chain (SEQ ID NO: 747)
QVQLVQSGSELKKPGASVKISCKASGYTFTNYGMNWVRQAPGQGLQWMGWINTDSGESTYAEEFKGRFVFSLDTSVN
TAYLQITSLTAEDTGMYFCVRVGYDALDYWGQGTLVTVSS \>pidilizumab[PD-1] variable light Chain (SEQ ID NO: 748)
EIVLTQSPSSLSASVGDRVTITCSARSSVSYMHWFQQKPGKAPKLWIYRTSNLASGVPSRFSGSGSGTSYCLTINSL
QPEDFATYYCQQRSSFPLTFGGGTKLEIK \>MK-3475[PD-1] variable heavy Chain (SEQ ID NO: 749)
QVQLVQSGVEVKKPGASVKVSCKASGYTFTNYYMYWVRQAPGQGLEWMGGINPSNGGTNFNEKFKNRVTLTTDSSTT
TAYMELKSLQFDDTAVYYCARRDYRFDMGFDYWGQGTTVTVSS \>MK-3475[PD-1] variable light Chain (SEQ ID NO: 750)
EIVLTQSPATLSLSPGERATLSCRASKGVSTSGYSYLHWYQQKPGQAPRLLIYLASYLESGVPARFSGSGSGTDFTL
TISSLEPEDFAVYYCQHSRDLPLTFGGGTKVEIK \>BAP049 Clone E[PD-1] variable heavy Chain (SEQ ID NO: 751)
EVQLVQSGAEVKKPGESLRISCKGSGYTFTTYWMHWVRQATGQGLEWMGNIYPGTGGSNFDEKFKNRVTITADKSTS
TAYMELSSLRSEDTAVYYCTRWTTGTGAYWGQGTTVTVSS \>BAP049 Clone E[PD-1] variable light Chain (SEQ ID NO: 752)
EIVLTQSPATLSLSPGERATLSCKSSQSLLDSGNQKNFLTWYQQKPGQAPRLLIYWASTRESGVPSRFSGSGSGTDF
TFTISSLEAEDAATYYCQNDYSYPYTFGQGTKVEIK

Figure 100C

\>BAP049 Clone B[PD-1] variable heavy Chain (SEQ ID NO: 753)
EVQLVQSGAEVKKPGESLRISCKGSGYTFTTYWMHWVRQATGQGLEWMGNIYPGTGGSNFDEKFKNRVTITADKSTS
TAYMELSSLRSEDTAVYYCTRWTTGTGAYWGQGTTVTVSS
\>BAP049 Clone B[PD-1] variable light Chain (SEQ ID NO: 754)
EIVLTQSPATLSLSPGERATLSCKSSQSLLDSGNQKNFLTWYQQKPGKAPKLLIYWASTRESGVPSRFSGSGSGTDF
TFTISSLQPEDIATYYCQNDYSYPYTFGQGTKVEIK
\>H7798N[PD-1] variable heavy Chain (SEQ ID NO: 755)
EVQLLESGGVLVQPGGSLRLSCAASGFTFSNFGMTWVRQAPGKGLEWVSGISGGGRDTYFADSVKGRFTISRDNSKN
TLYLQMNSLKGEDTAVYYCVKWGNIYFDYWGQGTLVTVSS
\>H7709N[PD-1] variable light Chain (SEQ ID NO: 756)
DIQMTQSPSSLSASVGDSITITCRASLSINTFLNWYQQKPGKAPNLLIYAASSLHGGVPSRFSGSGSGTDFTLTIRT
LQPEDFATYYCQQSSNTPFTFGPGTVVDFR
\>h1H3 Var 6[PD-1] variable heavy Chain (SEQ ID NO: 757)
EVQLVESGGGLVQPGGSLRLSCAASGFTFSDYGMHWVRQAPGKGLEWVAYISSGSYTIYYADSVKGRFTISRDNAKN
TLYLQMSSLRAEDTAVYYCARRGYGSFYEYYFDYWGQGTTVTVSS
\>h1H3 Var 6[PD-1] variable light Chain (SEQ ID NO: 758)
QIVLTQSPATLSLSPGERATLSCSASSSVSYMYWYQQKPGQAPRLLIYLTSNRATGIPARFSGSGSGTDYTLTISSL
EPEDFAVYYCQQWSSNPFTFGQGTKLEIK
\>APE2058[PD-1] variable heavy Chain (SEQ ID NO: 759)
EVQLLESGGGLVQPGGSLRLSCAASGFTFSSYDMSWVRQAPGKGLEWVSTISGGGSYTYYQDSVKGRFTISRDNSKN
TLYLQMNSLRAEDTAVYYCASPYYAMDYWGQGTTVTVSS
\>APE2058[PD-1] variable light Chain (SEQ ID NO: 760)
DIQLTQSPSFLSAYVGDRVTITCKASQDVGTAVAWYQQKPGKAPKLLIYWASTLHTGVPSRFSGSGSGTEFTLTISS
LQPEDFATYYCQHYSSYPWTFGQGTKLEIK
\>H005-1[PD-1] variable heavy Chain (SEQ ID NO: 761)
EVQLVESGGGLVQPGGSLRLSCAASGFTFSSYMMSWVRQAPGKGLEWVATISGGGANTYYPDSVKGRFTISRDNAKN
SLYLQMNSLRAEDTAVYYCARQLYYFDYWGQGTTVTVSS
\>H005-1[PD-1] variable light Chain (SEQ ID NO: 762)
DIQMTQSPSSLSASVGDRVTITCLASQTIGTWLTWYQQKPGKAPKLLIYTATSLADGVPSRFSGSGSGTDFTLTISS
LQPEDFATYYCQQVYSIPWTFGGGTKVEIK
\>317-4B6[PD-1] variable heavy Chain (SEQ ID NO: 763)
QVQLQESGPGLVKPSETLSLTCTVSGFSLTSYGVHWIRQPPGKGLEWIGVIYADGSTNYNPSLKSRVTISKDTSKNQ
VSLKLSSVTAADTAVYYCARAYGNYWYIDVWGQGTTVTVSS
\>317-4B6[PD-1] variable light Chain (SEQ ID NO: 764)
DIVMTQSPDSLAVSLGERATINCKSSESVSNDVAWYQQKPGQPPKLLINYAFHRFTGVPDRFSGSGYGTDFTLTISS
LQAEDVAVYYCHQAYSSPYTFGQGTKLEIK
\>326-4A3[PD-1] variable heavy Chain (SEQ ID NO: 765)
QVQLVQSGSELKKPGASVKVSCKASGYTFTNYGMNWVRQAPGQGLKWMGWINNNNAEPTYAQDFRGRFVFSLDTSAS
TAYLQISSLKTEDTAVYYCARDVMDYWGQGTLVTVSS
\>326-4A3[PD-1] variable light Chain (SEQ ID NO: 766)
DIVLTQSPASLAVSPGQRATITCRASESVDNYGYSFMHWYQQKPGQPPKLLIYRASNLESGVPARFSGSGSGTDFTL
TINPVEAEDTANYYCQQSKEYPTFGGGTKVEIK

Figure 100D

>hPD-1 mAb 7 (1.2)[PD-1] variable heavy Chain (SEQ ID NO: 767)
QVQLVQSGAEVKKPGASVKVSCKASGYSFTSYWMNWVRQAPGQGLEWIGVIHPSDSETWLDQKFKDRVTITVDKSTS
TAYMELSSLRSEDTAVYYCAREHYGTSPFAYWGQGTLVTVSS >hPD-1 mAb 7 (1.2)[PD-1] variable light Chain (SEQ ID NO: 768)
EIVLTQSPATLSLSPGERATLSCRASESVDNYGMSFMNWFQQKPGQPPKLLIHAASNQGSGVPSRFSGSGSGTDFTL
TISSLEPEDFAVYFCQQSKEVPYTFGGGTKVEIK >Clone 38[PD-1] variable heavy Chain (SEQ ID NO: 769)
QGQLVQSGAEVKKPGASVKVSCKASGYTFTDYEMHWVRQAPIHGLEWIGVIESETGGTAYNQKFKGRVTITADKSTS
TAYMELSSLRSEDTAVYYCAREGITTVATTYYWYFDVWGQGTTVTVSS >Clone 38[PD-1] variable light Chain (SEQ ID NO: 770)
DVVMTQSPLSLPVTLGQPASISCRSSQSIVHSNGNTYLEWYLQKPGQSPQLLIYKVSNRFSGVPDRFSGSGSGTDFT
LKISRVEAEDVGVYYCFQGSHVPLTFGQGTKLEIK >Clone 39[PD-1] variable heavy Chain (SEQ ID NO: 771)
QGQLVQSGAEVKKPGASVKVSCKASGYTFTDYEMHWVRQAPGQGLEWMGVIESETGGTAYNQKFKGRAKITADKSTS
TAYMELSSLRSEDTAVYYCTREGITTVATTYYWYFDVWGQGTTVTVSS >Clone 39[PD-1] variable light Chain (SEQ ID NO: 772)
DVVMTQSPLSLPVTLGQPASISCRSSQSIVHSNGNTYLEWYLQKPGQSPQLLIYKVSNRFSGVPDRFSGSGSGTDFT
LKISRVEAEDVGVYYCFQGSHVPLTFGQGTKLEIK >Clone 41[PD-1] variable heavy Chain (SEQ ID NO: 773)
QGQLVQSGAEVKKPGASVKVSCKASGYTFTDYEMHWVRQAPGQGLEWMGVIESETGGTAYNQKFQGRVTLTADKSSS
TAYMELSSLRSEDTAVYYCTREGITTVATTYYWYFDVWGQGTLVTVSS >Clone 41[PD-1] variable light Chain (SEQ ID NO: 774)
DVVMTQSPLSLPVTLGQPASISCRSSQSIVHSNGNTYLEWYLQKPGQSPQLLIYKVSNRFSGVPDRFSGSGSGTDFT
LKISRVEAEDVGVYYCFQGSHVPLTFGQGTKLEIK >Clone 48[PD-1] variable heavy Chain (SEQ ID NO: 775)
QGQLVQSGAEVKKPGASVKVSCKASGYTFTDYEMHWVRQAPGQGLEWMGVIESETGGTAYNQKFKGRAKITADKSTS
TAYMELSSLRSEDTAVYYCTREGITTVATTYYWYFDVWGQGTTVTVSS >Clone 48[PD-1] variable light Chain (SEQ ID NO: 776)
DVVMTQSPLSLPVTLGQPASISCRSSQSIVHSNGNTYLEWYLQKPGQSPRLLIYKVSNRFSGVPDRFSGSGSGTDFT
LKISRVEAEDVGVYYCFQGSHVPLTFGQGTKLEIK >PD1-17[PD-1] variable heavy Chain (SEQ ID NO: 777)
QVQLQESGPGVVKPSGTLSLTCAISGGSIGSGGSIRSTRWWSWVRQSPGKGLEWIGEIYHSGSTNYNPSLKSRVTIS
LDKSRNHFSLRLNSVTAADTAVYYCARQDYGDSGDWYFDLWGKGTMVTVSS >PD1-17[PD-1] variable light Chain (SEQ ID NO: 778)
NFMLTQPHSVSESPGKTVTISCTRSSGSIASNSVQWYQQRPGSSPTTVIYEDNQRPSGVPDRFSGSIDSSSNSASLT
VSGLKTEDEADYYCQSSDSSAVVFGSGTKLTVL >PD1-28[PD-1] variable heavy Chain (SEQ ID NO: 779)
EVQLVQSGAEVKKPGASVKVSCKASGYRFTSYGISWVRQAPGQGLEWMGWISAYNGNTNYAQKLQGRVTMTTDTSTN
TAYMELRSLRSDDTAVYYCARDADYSSGSGYWGQGTLVTVSS >PD1-28[PD-1] variable light Chain (SEQ ID NO: 780)
SYELTQPPSVSVSPGQTARITCSGDALPKQYAYWYQQKPGQAPVMVIYKDTERPSGIPERFSGSSSGTKVTLTISGV
QAEDEADYYCQSADNSITYRVFGGGTKVTVL

Figure 100E

\>PD1-33[PD-1] variable heavy Chain  (SEQ ID NO: 781)
QVQLVQSGAEVKKPGASVRVSCKASGYTLTSYYIHWVRQAPGQGLEWMGIINPRGATISYAQKFQGRVTMTRDTSTS
TVYMELRNLKSEDTALYYCATAGIYGFDFDYWGRGTLVTVSS \>PD1-33[PD-1] variable light Chain  (SEQ ID NO: 782)
QSALTQPASVSGSPGQSITISCTGTSNDVGGYNYVSWYQHHPGKAPKLIIYDVTNRPSGVSDRFSGSKSGNTASLTI
SGLLAEDEGDYYCSSYTIVTNFEVLFGGGTKLTV \>PD1-35[PD-1] variable heavy Chain  (SEQ ID NO: 783)
QVQLQESGPGLVKPSQTLSLTCTVSGGSISSGAYYWSWIRQHPGKGLEWIGYIYYNGNTYYNPSLRSLVTISVDASK
NQFSLKLSSVTAADTAVYYCARASDYVWGGYRYMDAFDIWGRGTLITVSS \>PD1-35[PD-1] variable light Chain  (SEQ ID NO: 784)
QSVLTQPPSASGTPGQRVTISCSGSNSNIGSNSVNWYQQLPGTAPKLLIYGNNQRPSGVPDRFSGSKSGTSASLAIS
GLQSENEADYYCAAWDDSLNGPVFGRGTKVTVLGE \>LOPD180[PD-1] variable heavy Chain  (SEQ ID NO: 785)
QVQLQESGPGLVKPSQTLSLTCTVSGGSISSGAYYWSWIRQHPGKGLEWIGYIYYNGNTYYNPSLRSRVTISVDTSK
NQFSLKLSSVTAADTAVYYCVRASDYVWGGYHYFDAFDLWGRGTLVTVSS \>LOPD180[PD-1] variable light Chain  (SEQ ID NO: 786)
QSVLTQPPSASGTPGQRVTISCSGSNSNIGSNSVNWYQQLPGTAPKLLIYGNNQRPSGVPDRFSGSKSGTSASLAIS
GLQSEDEADYYCAAWDDSLNGPVFGGGTKVTVL \>Ab948[PD-1] variable heavy Chain  (SEQ ID NO: 787)
EVQLQESGPGLVKPSQTLSLTCTVTGYSITSDYAWNWIRQPPGKKLEWMGYINYSGSTSYNPSLKSRVTISRDTSKN
QFSLKLSSVTAADTAVYYCARWIGSSAWYFDVWGQGTLVTVS \>Ab948[PD-1] variable light Chain  (SEQ ID NO: 788)
DVLMTQTPLSLSVTPGQPASISCRSGQNIVHSNGNTYLEWYLQKPGQSPKLLIYKVSNRFFGVPDRISGSGSGTDFT
LKISRVEAEDVGVYFCFQGSHVPFTFGQGTKLEIK \>humanized EH-12.2H7[PD-1] variable heavy Chain  (SEQ ID NO: 789)
QVQLVQSGHEVKQPGASVKMSCKASGYSFTSSWIHWVRQAPGQGLEWIGYIYPSTGFTEYNQKFKDRATLTADKSTS
TAYMELSSLRSEDTAVYYCARWRDSSGYHAMDYWGQGTLVTVSS \>humanized EH-12.2H7[PD-1] variable light Chain  (SEQ ID NO: 790)
EIVLTQSPATLSLSPGQRLTISCRASQSVSTSGYSYMHWYQQKPDQSPKLLIKFGSNLESGIPARFSGSGSGTDFTL
TISSLEPEDFATYYCQHSWEIPYTFGQGTKLEIK \>RG1H10[PD-1] variable heavy Chain (SEQ ID NO: 791)
QVQLVQSGSELKKPGASVKISCKASGYIFSDNGVNWVRQAPGQGLEWMGWINTKIGNPTYAQGFTGRFVFSLDTSIS
TTYLQISSLQAGDTAVYYCAREHDYYYGMDVWGQGTTVTVSS \>RG1H10[PD-1] variable light Chain  (SEQ ID NO: 792)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL \>RG1H10-H2A-22-1S[PD-1] variable heavy Chain  (SEQ ID NO: 793)
QVQLVQSGSELKKPGASVKISCKASGYIFSDNGVNWVRQAPGQGLEWMGWINTKDGNPTYAQGFTGRFVFSLDTSIS
TTYLQISSLQAGDTAVYYCAREHDYYYGMDVWGQGTTVTVSS \>RG1H10-H2A-22-1S[PD-1] variable light Chain  (SEQ ID NO: 794)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL

Figure 100F

>RG1H10-H2A-27-2S[PD-1] variable heavy Chain (SEQ ID NO: 795)
QVQLVQSGSELKKPGASVKISCKASGYIFSDNGVNWVRQAPGQGLEWMGWINTKTGNPTYAQGFTGRFVFSLDTSIS
TTYLQISSLQAGDTAVYYCAREHDYYYGMDVWGQGTTVTVSS >RG1H10-H2A-27-2S[PD-1] variable light Chain (SEQ ID NO: 796)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL >RG1H10-3C[PD-1] variable heavy Chain (SEQ ID NO: 797)
QVQLVQSGSELKKPGASVKISCKASGYTFSDNGVNWVRQAPGQGLEWMGWINTKDGNPTYAQGFTGRFVFSLDTSIS
TTYLQISSLQAGDTAVYYCAREHDYYYGMDVWGQGTTVTVSS >RG1H10-3C[PD-1] variable light Chain (SEQ ID NO: 798)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL >RG1H10-16C[PD-1] variable heavy Chain (SEQ ID NO: 799)
QVQLVQSGSELKKPGASVKISCKASGYTFSDNGVNWVRQAPGQGLEWMGWINTKTGNPTYAQGFTGRFVFSLDTSIS
TTYLQISSLQAGDTAVYYCAREHDYYYGMDVWGQGTTVTVS >RG1H10-16C[PD-1] variable light Chain (SEQ ID NO: 800)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL >RG1H10-17C[PD-1] variable heavy Chain (SEQ ID NO: 801)
QVQLVQSGSELKKPGASVKISCKASGYKFSDNGVNWVRQAPGQGLEWMGWINTKSGNPTYAQGFTGRFVFSLDTSIS
TTYLQISSLQAGDTAVYYCAREHDYYYGMDVWGQGTTVTVSS >RG1H10-17C[PD-1] variable light Chain (SEQ ID NO: 802)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL >RG1H10-19C[PD-1] variable heavy Chain (SEQ ID NO: 803)
QVQLVQSGSELKKPGASVKISCKASGYKFSDNGVNWVRQAPGQGLEWMGWINTKTGNPTYAQGFTGRFVFSLDTSIS
TTYLQISSLQAGDTAVYYCAREHDYYYGMDVWGQGTTVTVSS >RG1H10-19C[PD-1] variable light Chain (SEQ ID NO: 804)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL >RG1H10-21C[PD-1] variable heavy Chain (SEQ ID NO: 805)
QVQLVQSGSELKKPGASVKISCKASGYTFSDNGVNWVRQAPGQGLEWMGWINTKSGNPTYAQGFTGRFVFSLDTSIS
TTYLQISSLQAGDTAVYYCAREHDYYYGMDVWGQGTTVTVSS >RG1H10-21C[PD-1] variable light Chain (SEQ ID NO: 806)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL >RG1H10-23C2[PD-1] variable heavy Chain (SEQ ID NO: 807)
QVQLVQSGSELKKPGASVKISCKASGYKFSDNGVNWVRQAPGQGLEWMGWINTKDGNPTYAQGFTGRFVFSLDTSIS
TTYLQISSLQAGDTAVYYCAREHDYYYGMDVWGQGTTVTVSS >RG1H10-23C2[PD-1] variable light Chain (SEQ ID NO: 808)
QSALTQPPSASGSPGQSVTISCTGTSSDVGGYNYVSWYQHHPGKAPKLMIYEVSKRPSGVPDRFSGSKSAITASLTI
SGLLTEDEADYYCSAWDDSLNADVFGGGTKVTVL

Figure 100G

>mAb7[PD-1] variable heavy Chain (SEQ ID NO: 809)
QVQLVQSGAEVKKPGASVKVSCKASGYTFTSYWINWVRQAPGQGLEWMGNIYPGSSLTNYNEKFKNRVTMTRDTSTS
TVYMELSSLRSEDTAVYYCARLSTGTFAYWGQGTLVTVSS

>mAb7[PD-1] variable light Chain (SEQ ID NO: 810)
DIVMTQSPDSLAVSLGERATINCKSSQSLWDSGNQKNFLTWYQQKPGQPPKLLIYWTSYRESGVPDRFSGSGSGTDF
TLTISSLQAEDVAVYYCQNDYFYPHTFGGGTKVEIK

>PD1AB-6[PD-1] variable heavy Chain (SEQ ID NO: 811)
EVQLVQSGAEVKKPGATVKISCKASGFNIKDTYMHWVQQAPGKGLEWMGRIDPANGDRKYDPKFQGRVTITADTSTD
TAYMELSSLRSEDTAVYYCARSGPVYYYGSSYVMDYWGQGTTVTVSS

>PD1AB-6[PD-1] variable light Chain (SEQ ID NO: 812)
DIVMTQSPDSLAVSLGERATINCKSGQSVLYSSNQKNFLAWYQQKPGQPPKLLIYWASTRESGVPDRFSGSGSGTDF
TLTISSLQAEDVAVYYCHQYLYSWTFGQGTKLEIK

Figure 101

>XENP25953 1C11[PD-1]_H3L3_Fab-huIL10_huIL10_(G4S)2-Fc(216)_IgG1_PVA_/S267K_pI(-)_Isosteric_A_L368D/K370S-IgG1_C220S/S364K/E357Q

XENP25953 Chain 1 - 1C11[PD-1]_H3_IgG1_PVA_/S267K_pI(-)_Isosteric_A_L368D/K370S HC (SEQ ID NO: 813)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

XENP25953 Chain 2 - huIL10_huIL10_(G4S)2-Fc(216)_IgG1_C220S/S364K/E357Q (SEQ ID NO: 814)
*SPGQGTQSENSCTHFPGNLPNMLRDLRDAFSRVKTFFQMKDQLDNLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDNLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN/GGGGSGGGGS/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREMTKNQVKLTCLVKGFYPSDIAVEWESNGQPENNYKTTPPVLDSDGSFFLYSKLTVDKSRWQQGNVF
SCSVMHEALHNHYTQKSLSLSPGK*

XENP25953 Chain 3 - 1C11[PD-1]_L3 LC (SEQ ID NO: 815)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

Figure 102A

<u>>XENP27830 1C11[PD-1]_H3L3_Fab-huIL10.22_huIL10.22_(G4S)2-IgG1_pI(-</u>
<u>)_Isosteric_A_PVA_/S267K/L368D/K370S-Fc(216)_IgG1_C220S/PVA_/S267K/S364K/E357Q</u>

XENP27830 Chain 1 - 1C11[PD-1]_H3_IgG1_pI(-)_Isosteric_A_PVA_/S267K/L368D/K370S (SEQ ID NO: 816)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

XENP27830 Chain 2 - huIL10.22_huIL10.22_(G4S)2_Fc(216)_IgG1_C220S/PVA_/S267K/S364K/E357Q (SEQ ID NO: 817)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN*/GGGGSGGGGS/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

XENP27830 Chain 3 - 1C11[PD-1]_L3 LC (SEQ ID NO: 818)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC <u>>XENP27831 1C11[PD-1]_H3L3_Fab-huIL10.64_huIL10.64_(G4S)2-IgG1_pI(-</u>
<u>)_Isosteric_A_PVA_/S267K/L368D/K370S-Fc(216)_IgG1_C220S/PVA_/S267K/S364K/E357Q</u>

XENP27831 Chain 1 - 1C11[PD-1]_H3_IgG1_pI(-)_Isosteric_A_PVA_/S267K/L368D/K370S (SEQ ID NO: 819)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

Figure 102B

XENP27831 Chain 2 - huIL10.64_huIL10.64_(G4S)2_Fc(216)_IgG1_C220S/PVA_/S267K/S364K/E357Q (SEQ ID NO: 820)

*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCLRFLPCENKSKAVEQVKNAFNKLQEKGIYKAMSEFNIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCLRFLPCENKSKAVEQVKNAFNKLQEKGIYKAMSEFDIFIN
YIEAYMTMKIRN*/GGGGSGGGGS/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSGSFFLYSKLTVDKSRWQQGNVF
SCSVMHEALHNHYTQKSLSLSPGK

XENP27831 Chain 3 - 1C11[PD-1]_L3 LC (SEQ ID NO: 821)

DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

**XENP31269 1C11[PD-1]_H3L3_Fab-huIL10.102_huIL10.102_(G4S)2-IgG1_pI(-
)_Isosteric_A_PVA_/S267K/L368D/K370S-IgG1_C220S/PVA_/S267K/S364K/E357Q**

Chain 1 - 1C11[PD-1]_H3_IgG1_pI(-)_Isosteric_A_PVA_/S267K/L368D/K370S (SEQ ID NO: 822)

QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSGSFFLYSKLTVDKSRWEQGDVFSCSVMHEALHNHYTQKSLSLSPGK

Chain 2 - huIL10.102_huIL10.102_(G4S)2_IgG1_C220S/PVA_/S267K/S364K/E357Q (SEQ ID NO: 823)

*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR*/GGGGSGGGGS/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSGSFFLYSKLTVDKSRWQQGNVFS
CSVMHEALHNHYTQKSLSLSPGK

Chain 3 - 1C11[PD-1]_L3 (SEQ ID NO: 824)

DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

**XENP31270 1C11[PD-1]_H3L3_Fab-huIL10.105_huIL10.105_(G4S)2-IgG1_pI(-
)_Isosteric_A_PVA_/S267K/L368D/K370S-IgG1_C220S/PVA_/S267K/S364K/E357Q**

Chain 1 - 1C11[PD-1]_H3_IgG1_pI(-)_Isosteric_A_PVA_/S267K/L368D/K370S (SEQ ID NO: 825)

QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSGSFFLYSKLTVDKSRWEQGDVFSCSVMHEALHNHYTQKSLSLSPGK

Figure 102C

Chain 2 - huIL10.105_huIL10.105_(G4S)2_IgG1_C220S/PVA_/S267K/S364K/E357Q (SEQ ID NO: 826)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFNIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR*/GGGGSGGGGS/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Chain 3 - 1C11[PD-1]_L3 (SEQ ID NO: 827)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

Figure 103

<ins>XENP31271 1C11[PD-1]_H3L3_Fab-empty_Fc-IgG1_pI(-)_Isosteric_A_PVA_/S267K/L368D/K370S-Fc(216)_IgG1_C220S/PVA_/S267K/S364K/E357Q/K447del_(G4S)3_huIL10.102_huIL10.102</ins>

Chain 1 - 1C11[PD-1]_H3_IgG1_pI(-)_Isosteric_A_PVA_/S267K/L368D/K370S  (SEQ ID NO: 828)
QIQLVQSGSELKKPGASVKVSCKASGYTFT<ins>HYGMN</ins>WVRQAPGQGLEWMG<ins>WINTYTGEPTYADGFTGR</ins>FVFSLDTSVS
TAYLQISSLKAEDTAVYFCARD<ins>YYGSSPYW</ins>GQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

Chain 2 - empty_Fc_Fc(216)_IgG1_C220S/PVA_/S267K/S364K/E357Q/K447del_(G4S)3_huIL10.102_huIL10.102 (SEQ ID NO: 829)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
<ins>GGGGSGGGGSGGGGS</ins>/*SPGQGTQSENSCTHFPGNLPNMLRDLRDAFSRVKTFFQMKDQLDDLLLKESLLEDFKGYLG*
*CQALSEMIQFYLEEVMPQAENQDPDIKAHVNSLGENLKTLRLRLRRCHRFLPCENKSKAVEQVKNAFNKLQEKGIYK*
*AMSEFDIFINYIEAYMTMKIRNSPGQGTQSENSCTHFPGNLPNMLRDLRDAFSRVKTFFQMKDQLDDLLLKESLLED*
*FKGYLGCQALSEMIQFYLEEVMPQAENQDPDIKAHVNSLGENLKTLRLRLRRCHRFLPCENKSKAVEQVKNAFNKLQ*
*EKGIYKAMSEFDIFINYIEAYMTMKIRN*

Chain 3 - 1C11[PD-1]_L3  (SEQ ID NO: 830)
DVLMTQSPDSLAVSLGERATINCK<ins>SSQSIVHSNGNTYLE</ins>WYQQKPGQSPKLLIY<ins>KVSNRF</ins>SGVPDRFSGSGSGTDFT
LTISSLQAEDVAVYYC<ins>FQGSHVPNT</ins>FGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC <ins>XENP31272 1C11[PD-1]_H3L3_Fab-empty_Fc-IgG1_pI(-)_Isosteric_A_PVA_/S267K/L368D/K370S-Fc(216)_IgG1_C220S/PVA_/S267K/S364K/E357Q/K447del_(G4S)3_huIL10.105_huIL10.105</ins>

Chain 1 - 1C11[PD-1]_H3_IgG1_pI(-)_Isosteric_A_PVA_/S267K/L368D/K370S  (SEQ ID NO: 831)
QIQLVQSGSELKKPGASVKVSCKASGYTFT<ins>HYGMN</ins>WVRQAPGQGLEWMG<ins>WINTYTGEPTYADGFTGR</ins>FVFSLDTSVS
TAYLQISSLKAEDTAVYFCARD<ins>YYGSSPYW</ins>GQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

Chain 2 - empty_Fc_Fc(216)_IgG1_C220S/PVA_/S267K/S364K/E357Q/K447del_(G4S)3_huIL10.105_huIL10.105 (SEQ ID NO: 832)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
<ins>GGGGSGGGGSGGGGS</ins>/*SPGQGTQSENSCTHFPGNLPNMLRDLRDAFSRVKTFFQMKDQLDDLLLKESLLEDFKGYLG*
*CQALSEMIQFYLEEVMPQAENQDPDIKAHVNSLGENLKTLRLRLRRCHRFLPCENKSKAVEQVKNAFNKLQEKGIYK*
*AMSEFDIFINYIEAYMTMKIRNSPGQGTQSENSCTHFPGNLPNMLRDLRDAFSRVKTFFQMKDQLDDLLLKESLLED*
*FKGYLGCQALSEMIQFYLEEVMPQAENQDPDIKAHVNSLGENLKTLRLRLRRCHRFLPCENKSKAVEQVKNAFNKLQ*
*EKGIYKAMSEFDIFINYIEAYMTMKIRN*

Chain 3 - 1C11[PD-1]_L3  (SEQ ID NO: 833)
DVLMTQSPDSLAVSLGERATINCK<ins>SSQSIVHSNGNTYLE</ins>WYQQKPGQSPKLLIY<ins>KVSNRF</ins>SGVPDRFSGSGSGTDFT
LTISSLQAEDVAVYYC<ins>FQGSHVPNT</ins>FGGGTKVEIK/RTVAAPSVFIFPPSDEQLKSGTASVVCLLNNFYPREAKVQW
zVDNALQSGNSQESVTEQDSKDSTYSLSSTLTLSKADYEKHKVYACEVTHQGLSSPVTKSFNRGEC

Figure 104A mAb A[PD-1]_H1 Variable Heavy (SEQ ID NO: 834)
QVQLQESGPGLVKPSQTLSLTCTVSGHSITSDYAWNWIRQPPGKKLEWIGYISYSGYTTYNPSLKSRVTISRDTSKN
QFSLKLSSVTAADTAVYFCARDLDYGPWFAYWGQGTLVTVSS mAb A[PD-1]_L1 Variable Light (SEQ ID NO: 835)
DIQMTQSPSSLSASVGDRVTITCRASENIHNYLAWYQQKPGKSPKLLVYNVKTLADGVPSRFSGSGSGTDYTLTISS
LQPEDFATYYCQHFWSSPWTFGGGTKVEIK mAb B[PD-1]_H1 Variable Heavy (SEQ ID NO: 836)
QVQLVQSGAEVKKPGASVKVSCKASGYTFTNFYIHWVRQAPGQSIEWMGSIYPNYGDTAYNQKFQGRVTMTVDKSIS
TAYMELSRLRSDDTAVYYCARGYSYAMDYWGQGTTVTVSS mAb B[PD-1]_L1 Variable Light (SEQ ID NO: 837)
DIQMTQSPSSLSASVGDRVTITCRASQGISGDLNWYQQKPGKTVKLLIYHTSSLHSGVPLRFSGSGSGTDYTLTISS
LQPEDFATYYCQYYSKDLLTFGAGTKLEIK mAb C[PD-1]_H1 Variable Heavy (SEQ ID NO: 838)
EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS mAb C[PD-1]_H1.19 Variable Heavy (SEQ ID NO: 839)
EVQLVESGGGLVQPGGSLRLSCAASGFTFSSLGMHWVRQAPGKGLEWVSYISSGSSIIYYADSVKGRFTISRDNAKN
SLYLQMNSLRAEDTAVYYCARGGRLVWSPDYWGQGTLVTVSS mAb C[PD-1]_H1.48 Variable Heavy (SEQ ID NO: 840)
EVQLVESGGGLVQPGGSLRLSCAASGFTFSSFGMHWVRQAPGKGLEWVSYISGGSSIIYYADSVKGRFTISRDNAKN
SLYLQMNSLRAEDTAVYYCARGGRLVWSPDYWGQGTLVTVSS mAb C[PD-1]_H1.125 Variable Heavy (SEQ ID NO: 841)
EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGELVWSPDYWGQGTLVTVSS mAb C[PD-1]_H1.130 Variable Heavy (SEQ ID NO: 842)
EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGYLVWSPDYWGQGTLVTVSS mAb C[PD-1]_H1.132 Variable Heavy (SEQ ID NO: 843)
EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGWLVWSPDYWGQGTLVTVSS mAb C[PD-1]_H1.169 Variable Heavy (SEQ ID NO: 844)
EVQLVESGGGLVQPGGSLRLSCAASGFTFSSLGMHWVRQAPGKGLEWVSYISGGSSIIYYADSVKGRFTISRDNAKN
SLYLQMNSLRAEDTAVYYCARGGRLVWSPDYWGQGTLVTVSS

Figure 104B mAb C[PD-1]_H1.175 Variable Heavy (SEQ ID NO: 845)
EVQLVESGGGLVQPGGSLRLSCAASGFTFSSLGMHWVRQAPGKGLEWVSYISGGSSIIYYADSVKGRFTISRDNAKN
SLYLQMNSLRAEDTAVYYCARGGWLVWSPDYWGQGTLVTVSS mAb C[PD-1]_H2 Variable Heavy (SEQ ID NO: 846)
EVQLVESGGGLVKPGGSLRLSCAASGFTFSSFGMHWVRQAPGKGLEWVGYISSGSSIIYYADPVKGRFTISRDNSKN
TLYLQMNSLKTEDTAVYYCARGGRLVWSPDYWGQGTLVTVSS mAb C[PD-1]_L1 Variable Light (SEQ ID NO: 847)
DIVMTQSPDSLAVSLGERATINCKSSQSLLNSGNQKNYLTWYQQKPGQPPKLLIYWASTRESGVPDRFTGSGSGTDF
TLTISSLQAEDVAVYYCQNDYSYPFTFGSGTKLEIK mAb C[PD-1]_L1.1 Variable Light (SEQ ID NO: 848)
DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK mAb C[PD-1]_L1.3 Variable Light (SEQ ID NO: 849)
DIVMTQSPDSLAVSLGERATINCKSSQSLLSSGNQKNYLTWYQQKPGQPPKLLIYWASTRESGVPDRFTGSGSGTDF
TLTISSLQAEDVAVYYCQNDYSYPFTFGSGTKLEIK mAb C[PD-1]_L1.45 Variable Light (SEQ ID NO: 850)
DIVMTQSPDSLAVSLGERATINCKSSQSLLNSGNQYNYLTWYQQKPGQPPKLLIYWASTRESGVPDRFTGSGSGTDF
TLTISSLQAEDVAVYYCQNDYSYPFTFGSGTKLEIK mAb C[PD-1]_L1.117 Variable Light (SEQ ID NO: 851)
DIVMTQSPDSLAVSLGERATINCKSSQSLLNSGNQKNYLTWYQQKPGQPPKLLIYWASTRESGVPDRFTGSGSGTDF
TLTISSLQAEDVAVYYCQNDYTYPFTFGSGTKLEIK mAb C[PD-1]_L1.129 Variable Light (SEQ ID NO: 852)
DIVMTQSPDSLAVSLGERATINCKSSQSLLNSGNQKNYLTWYQQKPGQPPKLLIYWASTRESGVPDRFTGSGSGTDF
TLTISSLQAEDVAVYYCQNDYSWPFTFGSGTKLEIK mAb C[PD-1]_L1.135 Variable Light (SEQ ID NO: 853)
DIVMTQSPDSLAVSLGERATINCKSSQSLLHSGNQYNYLTWYQQKPGQPPKLLIYWASTRESGVPDRFTGSGSGTDF
TLTISSLQAEDVAVYYCQNDYSYPFTFGSGTKLEIK mAb C[PD-1]_L1.136 Variable Light (SEQ ID NO: 854)
DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYTYPFTFGSGTKLEIK mAb C[PD-1]_L1.140 Variable Light (SEQ ID NO: 855)
DIVMTQSPDSLAVSLGERATINCKSSQSLLHSGNQYNYLTWYQQKPGQPPKLLIYWASTRESGVPDRFTGSGSGTDF
TLTISSLQAEDVAVYYCQNDYTYPFTFGSGTKLEIK mAb C[PD-1]_L2 Variable Light (SEQ ID NO: 856)
DIVMTQSPLSLPVTPGEPASISCRSSQSLLNSGNQKNYLTWYLQKPGQPPQLLIYWASTRESGVPDRFTGSGSGTDF
TLKISRVEAEDVGVYYCQNDYSYPFTFGSGTKLEIK

Figure 105

|  | nivolumab-based αPD-1 | in-house produced pembrolizumab | chimeric mAb A | chimeric mAb B | chimeric mAb C | PDL1-Fc |
|---|---|---|---|---|---|---|
| nivolumab-based αPD-1 | 0.0468 | 0.0143 | 0.9692 | 0.9248 | 0.9299 | 0.1582 |
| in-house produced pembrolizumab | 0.0816 | 0.0301 | 0.8851 | 0.8414 | 0.8542 | 0.1585 |
| chimeric mAb A | 1.0095 | 1.0145 | 0.0141 | 0.0106 | 0.0157 | 0.5737 |
| chimeric mAb B | 0.8851 | 0.9078 | 0.0368 | 0.0237 | 0.0222 | 0.3376 |
| chimeric mAb C | 0.8889 | 0.9079 | 0.0372 | 0.0161 | 0.0372 | 0.2058 |
| HBS-EP | 1 | 1 | 1 | 1 | 1 | 1 |
| PDL1-Fc | 0.5418 | 0.5045 | 0.9274 | 0.9341 | 0.9142 | 0.3162 |

Figure 106A

<u>XENP30520 mAb C[PD-1]_H1_L1.1_Fab-huIL10.104_huIL10.104_(G4S)2-IgG1_pI(-
)_Isosteric_A_PVA_/S267K/L368D/K370S-IgG1_C220S/PVA_/S267K/S364K/E357Q</u>

Chain 1 - mAb C[PD-1]_H1_IgG1_pI(-)_Isosteric_A_PVA_/S267K/L368D/K370S (SEQ ID NO: 857)
EVQLVESGGGLVQPGGSLRLSCAASGFTFS<u>SFGMH</u>WVRQAPGKGLEWVS<u>YISSGSSIIYYADSVKG</u>RFTISRDNAKN
SLYLQMNSLRAEDTAVYYCAR<u>GGRLVWSPDY</u>WGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - huIL10.104_huIL10.104_(G4S)2_IgG1_C220S/PVA_/S267K/S364K/E357Q (SEQ ID NO: 858)
*SPGQGTQSENSCTHFPGNLPNMLRDLRDAFSRVKTFFQMKNQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR*/<u>GGGGSGGGGS</u>/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Chain 3 - mAb C[PD-1]_L1.1 (SEQ ID NO: 859)
DIVMTQSPDSLAVSLGERATINC<u>KSSQSLLHSGNQKNYLT</u>WYQQKPGQPPKLLIY<u>WASTRES</u>GVPDRFTGSGSGTDF
TLTISSLQAEDVAVYYC<u>QNDYSYPFT</u>FGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC <u>XENP30521 mAb C[PD-1]_H1_L1.1_Fab-huIL10.105_huIL10.105_(G4S)2-IgG1_pI(-
)_Isosteric_A_PVA_/S267K/L368D/K370S-IgG1_C220S/PVA_/S267K/S364K/E357Q</u>

Chain 1 - mAb C[PD-1]_H1_IgG1_pI(-)_Isosteric_A_PVA_/S267K/L368D/K370S (SEQ ID NO: 860)
EVQLVESGGGLVQPGGSLRLSCAASGFTFS<u>SFGMH</u>WVRQAPGKGLEWVS<u>YISSGSSIIYYADSVKG</u>RFTISRDNAKN
SLYLQMNSLRAEDTAVYYCAR<u>GGRLVWSPDY</u>WGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - huIL10.105_huIL10.105_(G4S)2_IgG1_C220S/PVA_/S267K/S364K/E357Q (SEQ ID NO: 861)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFNIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR*/<u>GGGGSGGGGS</u>/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Chain 3 - mAb C[PD-1]_L1.1 (SEQ ID NO: 862)
DIVMTQSPDSLAVSLGERATINC<u>KSSQSLLHSGNQKNYLT</u>WYQQKPGQPPKLLIY<u>WASTRES</u>GVPDRFTGSGSGTDF
TLTISSLQAEDVAVYYC<u>QNDYSYPFT</u>FGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 106B

<u>XENP30522 mAb C[PD-1]_H1_L1.1_Fab-huIL10.107_huIL10.107_(G4S)2-IgG1_pI(-)_Isosteric_A_PVA_/S267K/L368D/K370S-IgG1_C220S/PVA_/S267K/S364K/E357Q</u>

Chain 1 - mAb C[PD-1]_H1_IgG1_pI(-)_Isosteric_A_PVA_/S267K/L368D/K370S (SEQ ID NO: 863)
EVQLVESGGGLVQPGGSLRLSCAASGFTFS<u>SFGMH</u>WVRQAPGKGLEWVS<u>YISSGSSIIYYADSVK</u>GRFTISRDNAKN
SLYLQMNSLRAEDTAVYYCAR<u>GGRLVWSPDY</u>WGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - huIL10.107_huIL10.107_(G4S)2_IgG1_C220S/PVA_/S267K/S364K/E357Q (SEQ ID NO: 864)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPDMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR/<u>GGGGSGGGGS</u>/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK*

Chain 3 - mAb C[PD-1]_L1.1 (SEQ ID NO: 865)
DIVMTQSPDSLAVSLGERATINCK<u>SSQSLLHSGNQKNYL</u>TWYQQKPGQPPKLLIY<u>WASTRES</u>GVPDRFTGSGSGTDF
TLTISSLQAEDVAVYYC<u>QNDYSYPFT</u>FGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC <u>XENP31266 mAb C[PD-1]_H1_L1.1_Fab-huIL10.102_huIL10.102_(G4S)2-IgG1_pI(-)_Isosteric_A_PVA_/S267K/L368D/K370S-IgG1_C220S/PVA_/S267K/S364K/E357Q</u>

Chain 1 - mAb C[PD-1]_H1_IgG1_pI(-)_Isosteric_A_PVA_/S267K/L368D/K370S (SEQ ID NO: 866)
EVQLVESGGGLVQPGGSLRLSCAASGFTFS<u>SFGMH</u>WVRQAPGKGLEWVS<u>YISSGSSIIYYADSVK</u>GRFTISRDNAKN
SLYLQMNSLRAEDTAVYYCAR<u>GGRLVWSPDY</u>WGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - huIL10.102_huIL10.102_(G4S)2_IgG1_C220S/PVA_/S267K/S364K/E357Q (SEQ ID NO: 867)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR/<u>GGGGSGGGGS</u>/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK*

Chain 3 - mAb C[PD-1]_L1.1 (SEQ ID NO: 868)
DIVMTQSPDSLAVSLGERATINCK<u>SSQSLLHSGNQKNYL</u>TWYQQKPGQPPKLLIY<u>WASTRES</u>GVPDRFTGSGSGTDF
TLTISSLQAEDVAVYYC<u>QNDYSYPFT</u>FGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 106C

<u>XENP31267 mAb C[PD-1]_H1_L1.1_Fab-empty_Fc-IgG1_pI(-)_Isosteric_A_PVA_/S267K/L368D/K370S-Fc(216)_IgG1_C220S/PVA_/S267K/S364K/E357Q/K447del_(G4S)3_huIL10.102_huIL10.102</u>

Chain 1 - mAb C[PD-1]_H1_IgG1_pI(-)_Isosteric_A_PVA_/S267K/L368D/K370S (SEQ ID NO: 869)
EVQLVESGGGLVQPGGSLRLSCAASGFTFS<u>SFGMH</u>WVRQAPGKGLEWVS<u>YISSGSSIIYYADSVKG</u>RFTISRDNAKN
SLYLQMNSLRAEDTAVYYCAR<u>GGRLVWSPDY</u>WGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - empty_Fc_Fc(216)_IgG1_C220S/PVA_/S267K/S364K/E357Q/K447del_(G4S)3_huIL10.102_huIL10.102 (SEQ ID NO: 870)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
<u>GGGGSGGGGSGGGGS</u>/*SPGQGTQSENSCTHFPGNLPNMLRDLRDAFSRVKTFFQMKDQLDDLLLKESLLEDFKGYLG*
*CQALSEMIQFYLEEVMPQAENQDPDIKAHVNSLGENLKTLRLRLRRCHRFLPCENKSKAVEQVKNAFNKLQEKGIYK*
*AMSEFDIFINYIEAYMTMKIRNSPGQGTQSENSCTHFPGNLPNMLRDLRDAFSRVKTFFQMKDQLDDLLLKESLLED*
*FKGYLGCQALSEMIQFYLEEVMPQAENQDPDIKAHVNSLGENLKTLRLRLRRCHRFLPCENKSKAVEQVKNAFNKLQ*
*EKGIYKAMSEFDIFINYIEAYMTMKIRN*

Chain 3 - mAb C[PD-1]_L1.1 (SEQ ID NO: 871)
DIVMTQSPDSLAVSLGERATINCK<u>SSQSLLHSGNQKNYLT</u>WYQQKPGQPPKLLIY<u>WASTRES</u>GVPDRFTGSGSGTDF
TLTISSLQAEDVAVYYC<u>QNDYSYPFT</u>FGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC <u>XENP31268 mAb C[PD-1]_H1_L1.1_Fab-empty_Fc-IgG1_pI(-)_Isosteric_A_PVA_/S267K/L368D/K370S-Fc(216)_IgG1_C220S/PVA_/S267K/S364K/E357Q/K447del_(G4S)3_huIL10.105_huIL10.105</u>

Chain 1 - mAb C[PD-1]_H1_IgG1_pI(-)_Isosteric_A_PVA_/S267K/L368D/K370S (SEQ ID NO: 872)
EVQLVESGGGLVQPGGSLRLSCAASGFTFS<u>SFGMH</u>WVRQAPGKGLEWVS<u>YISSGSSIIYYADSVKG</u>RFTISRDNAKN
SLYLQMNSLRAEDTAVYYCAR<u>GGRLVWSPDY</u>WGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - empty_Fc_Fc(216)_IgG1_C220S/PVA_/S267K/S364K/E357Q/K447del_(G4S)3_huIL10.105_huIL10.105 (SEQ ID NO: 873)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
<u>GGGGSGGGGSGGGGS</u>/*SPGQGTQSENSCTHFPGNLPNMLRDLRDAFSRVKTFFQMKDQLDDLLLKESLLEDFKGYLG*
*CQALSEMIQFYLEEVMPQAENQDPDIKAHVNSLGENLKTLRLRLRRCHRFLPCENKSKAVEQVKNAFNKLQEKGIYK*
*AMSEFDIFINYIEAYMTMKIRNSPGQGTQSENSCTHFPGNLPNMLRDLRDAFSRVKTFFQMKDQLDDLLLKESLLED*
*FKGYLGCQALSEMIQFYLEEVMPQAENQDPDIKAHVNSLGENLKTLRLRLRRCHRFLPCENKSKAVEQVKNAFNKLQ*
*EKGIYKAMSEFDIFINYIEAYMTMKIRN*

Chain 3 - mAb C[PD-1]_L1.1 (SEQ ID NO: 874)
DIVMTQSPDSLAVSLGERATINCK<u>SSQSLLHSGNQKNYLT</u>WYQQKPGQPPKLLIY<u>WASTRES</u>GVPDRFTGSGSGTDF
TLTISSLQAEDVAVYYC<u>QNDYSYPFT</u>FGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 111

Human TIGIT sequence (SEQ ID NO: 875)

>sp|Q9Y6W8

MKSGLWYFFLFCLRIKVLTGEINGSANYEMFIFHNGGVQILCKYPDIVQQFKMQLLKGGQILCDLTKTKGSGNTVSI
KSLKFCHSQLSNNSVSFFLYNLDHSHANYYFCNLSIFDPPPFKVTLTGGYLHIYESQLCCQLKFWLPIGCAAFVVVC
ILGCILICWLTKKKYSSSVHDPNGEYMFMRAVNTAKKSRLTDVTL

Human TIGIT sequence, extracellular domain (SEQ ID NO: 876)

>sp|Q9Y6W8|21-140

EINGSANYEMFIFHNGGVQILCKYPDIVQQFKMQLLKGGQILCDLTKTKGSGNTVSIKSLKFCHSQLSNNSVSFFLY
NLDHSHANYYFCNLSIFDPPPFKVTLTGGYLHIYESQLCCQLK

Macaca fascicularis TIGIT sequence (SEQ ID NO: 877)

>gi|544477053|ref|XP_005574075.1

MKSGLWYFFLFCLHMKVLTGEINGSANYEMFIFHNGGVQILCKYPDIVQQFKMQLLKGGQILCDLTKTKGSGNTVSI
KSLKFCHSQLSNNSVSFFLYNLDRSHANYYFCNLSIFDPPPFKVTLTGGYLHIYESQLCCQLKFWLPIGCATFVVVC
IFGCILICWLTKKKYSSTVHDPNGEYMFMRAVNTAKKSRLTDVTV

Macaca fascicularis TIGIT sequence, extracellular domain (predicted) (SEQ ID NO: 878)

>gi|544477053|ref|XP_005574075.1|21-140

EINGSANYEMFIFHNGGVQILCKYPDIVQQFKMQLLKGGQILCDLTKTKGSGNTVSIKSLKFCHSQLSNNSVSFFLY
NLDRSHANYYFCNLSIFDPPPFKVTLTGGYLHIYESQLCCQLK

Figure 112

> XENP27507 2A5B4[TIGIT]_H1L1_IgG1_PVA_/S267K

Heavy Chain - 2A5B4[TIGIT]_H1L1_IgG1_PVA_/S267K (SEQ ID NO: 879)
EVQLLESGGGLVQPGGSLRLSCAASGFTFSSYAMSWVRQAPGKGLEWVSGISGSGGTTYYADSVKGRFTISRDNSKN
TLYLQMNSLRAEDTAVYYCAKGPVYSARRGFDYWGQGTLVTSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK Light Chain - 2A5B4[TIGIT]_H1L1_IgG1_PVA_/S267K (SEQ ID NO: 880)
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 113

>XENP19351 10A7_H0L0_IgG1_PVA_/S267K

Heavy Chain - 10A7_H0_IgG1_PVA_/S267K (SEQ ID NO: 881)
EVQLVESGGGLTQPGKSLKLSCEASGFTFSSFTMHWVRQSPGKGLEWVAFIRSGSGIVFYADAVRGRFTISRDNAKN
LLFLQMNDLKSEDTAMYYCARRPLGHNTFDSWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREEMTKNQVSLTCLVKGFYPSDIAVEWES
NGQPENNYKTTPPVLDSDGSFFLYSKLTVDKSRWQQGNVFSCSVMHEALHNHYTQKSLSLSPGK

Light Chain - 10A7_L0 (SEQ ID NO: 882)
DIVMTQSPSSLAVSPGEKVTMTCKSSQSLYYSGVKENLLAWYQQKPGQSPKLLIYYASIRFTGVPDRFTGSGSGTDY
TLTITSVQAEDMGQYFCQQGINNPLTFGDGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 114

>XENP19352 1F4_H0L0_IgG1_PVA_/S267K

Heavy Chain - 1F4_H0_IgG1_PVA_/S267K (SEQ ID NO: 883)
EVQLQQSGPELVKPGTSMKISCKASGYSFTGHLMNWVKQSHGKNLEWIGLIIPYNGGTSYNQKFKGKATLTVDKSSS
TAYMELLSLTSDDSAVYFCSRGLRGFYAMDYWGQGTSVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREEMTKNQVSLTCLVKGFYPSDIAVEWES
NGQPENNYKTTPPVLDSDGSFFLYSKLTVDKSRWQQGNVFSCSVMHEALHNHYTQKSLSLSPGK

Light Chain - 1F4_L0 (SEQ ID NO: 884)
DVVLTQTPLSLSVSFGDQVSISCRSSQSLVNSYGNTFLSWYLHKPGQSPQLLIFGISNRFSGVPDRFSGSGSGTDFT
LKISTIKPEDLGMYYCLQGTHQPPTFGPGTKLEVK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

Figure 118

| | Human TIGIT | | | Cynomolgus TIGIT | | |
|---|---|---|---|---|---|---|
| Sample ID | $K_D$ (M) | $k_a$ (1/Ms) | $k_d$ (1/s) | $K_D$ (M) | $k_a$ (1/Ms) | $k_d$ (1/s) |
| XENP19351 | 3.15E-10 | 9.46E+05 | 2.98E-04 | 7.42E-09 | 8.64E+05 | 6.41E-03 |
| Clone A | 4.71E-10 | 2.29E+05 | 1.08E-04 | 1.42E-10 | 2.15E+05 | 3.04E-05 |
| XENP27507 | 6.68E-10 | 2.97E+05 | 1.99E-04 | 1.03E-08 | 6.28E+05 | 6.48E-03 |
| Clone B | 1.15E-09 | 3.29E+05 | 3.77E-04 | 1.17E-09 | 2.64E+05 | 3.09E-04 |
| Clone C | 7.59E-10 | 3.21E+05 | 2.43E-04 | 9.23E-10 | 3.67E+05 | 3.38E-04 |
| Clone D | 3.46E-11 | 3.03E+05 | 1.05E-05 | 2.27E-12 | 3.26E+05 | 7.38E-07 |
| Clone E | 5.42E-11 | 2.55E+05 | 1.38E-05 | 1.29E-10 | 2.52E+05 | 3.25E-05 |

Figure 119

| | Clone A | XENP27507 | Clone B | Clone C | Clone D | Clone E |
|---|---|---|---|---|---|---|
| XENP19351 | -0.00728 | 0.01070 | 0.03834 | 0.04398 | 0.00603 | 0.02171 |
| XENP19352 | 0.86462 | 0.83323 | 0.72377 | 0.69407 | 0.70484 | 0.67481 |
| HBS-EP | 1.00000 | 1.00000 | 1.00000 | 1.00000 | 1.00000 | 1.00000 |

Figure 122A

\>2A5B4[TIGIT]_H1 Variable Heavy (SEQ ID NO: 885)
EVQLLESGGGLVQPGGSLRLSCAASGFTFSSYAMSWVRQAPGKGLEWVSGISGSGGTTYYADSVKGRFTISRDNSKN
TLYLQMNSLRAEDTAVYYCAKGPVYSARRGFDYWGQGTLVTVSS \>2A5B4[TIGIT]_L1 Variable Light (SEQ ID NO: 886)
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK \>Genentech_4.1D3.Q1E(tiragolumab)[TIGIT]_H0 Variable Heavy (SEQ ID NO: 887)
EVQLQQSGPGLVKPSQTLSLTCAISGDSVSSNSAAWNWIRQSPSRGLEWLGKTYYRFKWYSDYAVSVKGRITINPDT
SKNQFSLQLNSVTPEDTAVFYCTRESTTYDLLAGPFDYWGQGTLVTVSS \>Genentech_4.1D3.Q1E(tiragolumab)[TIGIT]_L0 Variable Light (SEQ ID NO: 888)
DIVMTQSPDSLAVSLGERATINCKSSQTVLYSSNNKKYLAWYQQKPGQPPNLLIYWASTRESGVPDRFSGSGSGTDF
TLTISSLQAEDVAVYYCQQYYSTPFTFGPGTKVEIK \>10A7[TIGIT] variable heavy Chain (SEQ ID NO: 889)
EVQLVESGGGLTQPGKSLKLSCEASGFTFSSFTMHWVRQSPGKGLEWVAFIRSGSGIVFYADAVRGRFTISRDNAKN
LLFLQMNDLKSEDTAMYYCARRPLGHNTFDSWGQGTLVTVSS \>10A7[TIGIT] variable light Chain (SEQ ID NO: 890)
DIVMTQSPSSLAVSPGEKVTMTCKSSQSLYYSGVKENLLAWYQQKPGQSPKLLIYYASIRFTGVPDRFTGSGSGTDY
TLTITSVQAEDMGQYFCQQGINNPLTFGDGTKLEIK \>1F4[TIGIT] variable heavy Chain (SEQ ID NO: 891)
EVQLQQSGPELVKPGTSMKISCKASGYSFTGHLMNWVKQSHGKNLEWIGLIIPYNGGTSYNQKFKGKATLTVDKSSS
TAYMELLSLTSDDSAVYFCSRGLRGFYAMDYWGQGTSVTVSS \>1F4[TIGIT] variable light Chain (SEQ ID NO: 892)
DVVLTQTPLSLSVSFGDQVSISCRSSQSLVNSYGNTFLSWYLHKPGQSPQLLIFGISNRFSGVPDRFSGSGSGTDFT
LKISTIKPEDLGMYYCLQGTHQPPTFGPGTKLEVK \>4.1D3[TIGIT] variable heavy Chain (SEQ ID NO: 893)
QVQLQQSGPGLVKPSQTLSLTCAISGDSVSSNSAAWNWIRQSPSRGLEWLGKTYYRFKWYSDYAVSVKGRITINPDT
SKNQFSLQLNSVTPEDTAVFYCTRESTTYDLLAGPFDYWGQGTLVTVSS \>4.1D3[TIGIT] variable light Chain (SEQ ID NO: 894)
DIVMTQSPDSLAVSLGERATINCKSSQTVLYSSNNKKYLAWYQQKPGQPPNLLIYWASTRESGVPDRFSGSGSGTDF
TLTISSLQAEDVAVYYCQQYYSTPFTFGPGTKVEIK \>Hu14D7 VH1[TIGIT] variable heavy Chain (SEQ ID NO: 895)
EVQLVESGGGLVQPGGSLKLSCAASGFTFSGAWMDWVRQAPGKGLEWVAEIRTKVNNHATNYGESVKGRFTISRDDS
KSTVYLQMNSLRAEDTAVYYCRGALYDGFYFDYWGQGTLVTVSS \>Hu14D7 VH2[TIGIT] variable heavy Chain (SEQ ID NO: 896)
EVQLVESGGGLVQPGGSLKLSCAASGFTFSGAWMDWVRQAPGKGLEWVAEIRTKVNNHATNYGESVKGRFTISRDDS
KSSVYLQMNSLRAEDTAVYYCRGALYDGFYFDYWGQGTLVTVSS \>Hu14D7 VH3[TIGIT] variable heavy Chain (SEQ ID NO: 897)
EVQLVESGGGLVQPGGSLKLSCAASGFTFSGAWMDWVRQAPGKGLEWVAEIRTKVNNHATNYGESVKGRFTISRDDS
KNTVYLQMNSLRAEDTAVYYCRGALYDGFYFDYWGQGTLVTVSS \>Hu14D7 VL1[TIGIT] variable light Chain (SEQ ID NO: 898)
EIVLTQSPATLSLSPGERATLSCSASSSVSSGYLYWYQQKPGQAPKLWIYGTSTLASGVPARFSGSGSGTDYTLTIS
SLEPEDFAVYYCHQWSSFPYTFGQGTKLEIK

Figure 122B

>Hu14D7 VL2[TIGIT] variable light Chain (SEQ ID NO: 899)
EIVLTQSPATLSLSPGERATLSCSASSSVSSGYLYWYQQKPGQAPRLWIYGTSTLASGVPARFSGSGSGTDYTLTIS
SLEPEDFAVYYCHQWSSFPYTFGQGTKLEIK >Hu14D7 VL3[TIGIT] variable light Chain (SEQ ID NO: 900)
EIVLTQSPATLSLSPGERATLSCSASSSVSSGYLYWYQQKPGQAPRLWIYGTSTLASGIPARFSGSGSGTDYTLTIS
SLEPEDFAVYYCHQWSSFPYTFGQGTKLEIK >Hu26B10 VH1[TIGIT] variable heavy Chain (SEQ ID NO: 901)
EVQLVQSGAEVKKPGASVKISCKTSGYTFTEFTMHWVKQAPGKGLEWIGGLKPDNGGISYNQKFKGRATLTVDKSTN
TAYMELSSLRSEDTAVYYCARGAYYRYDADYWGQGTLVTVSS >Hu26B10 VH2[TIGIT] variable heavy Chain (SEQ ID NO: 902)
EVQLVQSGAEVKKPGASVKISCKTSGYTFTEFTMHWVRQAPGKGLEWIGGLKPDNGGISYNQKFKGRATLTVDKSTS
TAYMELSSLRSEDTAVYYCARGAYYRYDADYWGQGTLVTVSS >Hu26B10 VH3[TIGIT] variable heavy Chain (SEQ ID NO: 903)
EVQLVQSGAEVKKPGASVKISCKVSGYTFTEFTMHWVRQAPGKGLEWIGGLKPDNGGISYNQKFKGRATLTVDTSTS
TAYMELSSLRSEDTAVYYCARGAYYRYDADYWGQGTLVTVSS >Hu26B10 VL1[TIGIT] variable light Chain (SEQ ID NO: 904)
DIQLTQSPSSLSASVGDRVTITCKASQDVKTAVAWYQQKPGKAPKLLIYSASYRNTGVPDRFSGSGSGTDFTFTISS
LQPEDFATYYCQQHYSTPFTFGQGTKLEIK >Hu26B10 VL2[TIGIT] variable light Chain (SEQ ID NO: 905)
DIQLTQSPSSLSASVGDRVTITCKASQDVKTAVAWYQQKPGKAPKLLIYSASYRNTGVPSRFSGSGSGTDFTFTISS
LQPEDFATYYCQQHYSTPFTFGQGTKLEIK >Hu26B10 VL3[TIGIT] variable light Chain (SEQ ID NO: 906)
DIQLTQSPSSLSASVGDRVTITCKASQDVKTAVAWYQQKPGKAPKLLIYSASYRNTGVPSRFSGSGSGTDFTLTISS
LQPEDFATYYCQQHYSTPFTFGQGTKLEIK >MEB125.31C6.A1.205 VH4/VL1[TIGIT] variable heavy Chain (SEQ ID NO: 907)
EVQLVQSGAEVKKPGASVKVSCKASGYTFSSYVMHWVRQAPGQGLEWIGYIDPYNDGAKYAQKFQGRVTLTSDKSTS
TVYMELSSLRSEDTAVYYCARGGPYGWYFDVWGQGTTVTVSS >MEB125.31C6.A1.205 VH4/VL1[TIGIT] variable light Chain (SEQ ID NO: 908)
DIQMTQSPSSLSASVGDRVTITCRASEHIYSYLSWYQQKPGKAPKLLIYNAKTLAEGVPSRFSGSGSGTDFTLTISS
LQPEDFATYYCQHHFGSPLTFGQGTRLEIK >MEB125.31C6.A1.205 VH5/VL4[TIGIT] variable heavy Chain (SEQ ID NO: 909)
EVQLVQSGAEVKKPGSSVKVSCKASGYTFSSYVMHWVRQAPGQGLEWIGYIDPYNDGAKYAQKFQGRVTLTSDKSTS
TAYMELSSLRSEDTAVYYCARGGPYGWYFDVWGQGTTVTVSS >MEB125.31C6.A1.205 VH5/VL4[TIGIT] variable light Chain (SEQ ID NO: 910)
DIQMTQSPSSLSASVGDRVTITCRASEHIYSYLSWYQQKPGKVPKLLIYNAKTLAEGVPSRFSGSGSGTQFTLTISS
LQPEDVATYYCQHHFGSPLTFGQGTRLEIK >MEB125.31C6.A1.205 VH5/VL3[TIGIT] variable heavy Chain (SEQ ID NO: 911)
EVQLVQSGAEVKKPGSSVKVSCKASGYTFSSYVMHWVRQAPGQGLEWIGYIDPYNDGAKYAQKFQGRVTLTSDKSTS
TAYMELSSLRSEDTAVYYCARGGPYGWYFDVWGQGTTVTVSS >MEB125.31C6.A1.205 VH5/VL3[TIGIT] variable light Chain (SEQ ID NO: 912)
DIQMTQSPSSLSASVGDRVTITCRASEHIYSYLSWYQQKPGKVPKLLIYNAKTLAEGVPSRFSGSGSGTDFTLTISS
LQPEDVATYYCQHHFGSPLTFGQGTRLEIK

Figure 122C

\>15A6[TIGIT] variable heavy Chain (SEQ ID NO: 913)
QLQLQESGPGLVKPSETLSLTCTVSGGSISSSRYFWGWIRQPPGKGLEWIGYIYYRGSTYYNPSLKSRVTIAVDTSK
NQFSLKLSSVTAADTAVYYCASSSAWYFDYWGQGNLVTVSS \>15A6[TIGIT] variable light Chain (SEQ ID NO: 914)
EIVLTQSPGTLSLSPGERATLSCRASQSVSSSYLAWYQQKPGQAPRLLIYGASSRATGIPDRFSGSGSGTDFTLTIS
RLEPEDFAVYYCQQYGSLYTFGQGTKLEIK \>22G2[TIGIT] variable heavy Chain (SEQ ID NO: 915)
QVHLQESGPGLVKPSETLSLTCTVSGGSVSSGIYYWSWIRQPPGKGLEWIGYIYYSGSTNYNPSLKSRVTISVDTSK
NQFSLKLSSVTAADTAVYYCARDYYVSGNYYNVDYYFFGVDVWGQGTTVTVSS \>22G2[TIGIT] variable light Chain (SEQ ID NO: 916)
EIVLTQSPATLSLSPGERATLSCRASQSVSSYLAWYQQKPGQAPRLLIYDASNRATGIPARFSGSGSGTDFTLTISS
LEPEDFAVYYCQQRSNWPPLFTFGPGTKVDIK \>11G11[TIGIT] variable heavy Chain (SEQ ID NO: 917)
QLQLQESGPGLVKPSETLSLTCTVSGGSISSSSHYWGWIRQPPGKGLEWIGNIFYSGHTYYNPSLKSRVTISVDTSK
NQFSLKLSSVTAADTAVYYCARQGLLWFGGLSPYYFDYWGQGTLVTVSS \>11G11[TIGIT] variable light Chain (SEQ ID NO: 918)
EIVLTQSPATLSLSPGERATLSCRASQSVSSYLAWYQQKPGQAPRLLIYDASNRATGIPARFSGSGSGTDFTLTISS
LEPEDFAVYYCQQRSNWPTFGQGTKLEIK \>10D7[TIGIT] variable heavy Chain (SEQ ID NO: 919)
QGQLVQSGAEVKKPGSSVKVSCKASGGIFRNYAISWVRQAPGQGLEWMGGIIPFFGTANYAQKFQGRVTITADESTS
TAYMELSSLRSEDTAVYYCARGGAAAGTTRYGYYYGMDVWGQGTTVTVSS \>10D7[TIGIT] variable light Chain (SEQ ID NO: 920)
DIQMTQSPSSLSASVGDRVTITCRASQGISSWLAWYQQKPEKAPKSLIYAASSLQSGVPSRFSGSGSGTDFTLTISS
LQPEDFATYYCQQYNSYPITFGQGTRLEIK \>313R19[TIGIT] variable heavy Chain (SEQ ID NO: 921)
QVQLQESGPGLVKPSETLSLTCTVSGFSLSSSYMSWIRQPPGKGLEWIGIIGSNGNTYYANWAKGRVTISKSSNQVS
LKLSSVTAADTAVYYCARGGYRTSGMDPWGQGTLVTVSS \>313R19[TIGIT] variable light Chain (SEQ ID NO: 922)
DIQMTQSPSSLSASVGDRVTITCQASQNIYSDLAWYQQKPGKAPKLLIYRASTLASGVPSRFSGSGSGTDFTLTISS
LQPEDFATYYCQQEHLVAWIYNVFGQGTKVEIK \>etigilimab[TIGIT] variable heavy Chain (SEQ ID NO: 923)
QVQLQESGPGLVKPSETLSLTCAVSGYSITSDYAWNWIRQPPGKGLEWIGYISYSGSTSYNPSLRSRVTISRDTSKN
QFFLKLSSVTAADTAVYYCARRQVGLGFAYWGQGTLVTVSS \>etigilimab[TIGIT] variable light Chain (SEQ ID NO: 924)
DIQMTQSPSSLSASVGDRVTITCKASQDVSTAVAWYQQKPGKAPKLLIYSASYRYTGVPSRFSGSGSGTDFTFTISS
LQPEDIATYYCQQHYSTPWTFGQGTKVEIK

Figure 123A

<u>XENP30523 2A5B4[TIGIT]_H1L1_Fab-huIL10.104_huIL10.104_(G4S)2-IgG1_pI(-
)_Isosteric_A_PVA_/S267K/L368D/K370S-IgG1_C220S/PVA_/S267K/S364K/E357Q</u>

Chain 1 - 2A5B4[TIGIT]_H1_IgG1_pI(-)_Isosteric_A_PVA_/S267K/L368D/K370S (SEQ ID NO: 925)
EVQLLESGGGLVQPGGSLRLSCAASGFTFS<u>SYAMS</u>WVRQAPGKGLEWVS<u>GISGSGGTTYYADSVKG</u>RFTISRDNSKN
TLYLQMNSLRAEDTAVYYCAK<u>GPVYSARRGFDY</u>WGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 2 - huIL10.104_huIL10.104_(G4S)2_IgG1_C220S/PVA_/S267K/S364K/E357Q (SEQ ID NO: 926)
*SPGQGTQSENSCTHFPGNLPNMLRDLRDAFSRVKTFFQMKNQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFDIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR*/<u>GGGGSGGGGS</u>/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Chain 3 - 2A5B4[TIGIT]_L1 (SEQ ID NO: 927)
DIQMTQSPSSLSASVGDRVTITC<u>RASQSISSYLN</u>WYQQKPGKAPKLLIY<u>AASSLQS</u>GVPSRFSGSGSGTDFTLTISS
LQPEDFATYYC<u>QQSYSTPYT</u>FGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC <u>XENP30524 2A5B4[TIGIT]_H1L1_Fab-huIL10.105_huIL10.105_(G4S)2-IgG1_pI(-
)_Isosteric_A_PVA_/S267K/L368D/K370S-IgG1_C220S/PVA_/S267K/S364K/E357Q</u>

Chain 1 - 2A5B4[TIGIT]_H1_IgG1_pI(-)_Isosteric_A_PVA_/S267K/L368D/K370S (SEQ ID NO: 928)
EVQLLESGGGLVQPGGSLRLSCAASGFTFS<u>SYAMS</u>WVRQAPGKGLEWVS<u>GISGSGGTTYYADSVKG</u>RFTISRDNSKN
TLYLQMNSLRAEDTAVYYCAK<u>GPVYSARRGFDY</u>WGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 2 - huIL10.105_huIL10.105_(G4S)2_IgG1_C220S/PVA_/S267K/S364K/E357Q (SEQ ID NO: 929)
*SPGQGTQSENSCTHFPGNLPNMLRDLRDAFSRVKTFFQMKDQLDDLLLKESLLEDFKGYLGCQALSEMIQFYLEEVM
PQAENQDPDIKAHVNSLGENLKTLRLRLRRCHRFLPCENKSKAVEQVKNAFNKLQEKGIYKAMSEFNIFINYIEAYM
TMKIRNSPGQGTQSENSCTHFPGNLPNMLRDLRDAFSRVKTFFQMKDQLDDLLLKESLLEDFKGYLGCQALSEMIQF
YLEEVMPQAENQDPDIKAHVNSLGENLKTLRLRLRRCHRFLPCENKSKAVEQVKNAFNKLQEKGIYKAMSEFDIFIN
YIEAYMTMKIR*/<u>GGGGSGGGGS</u>/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Chain 3 - 2A5B4[TIGIT]_L1 (SEQ ID NO: 930)
DIQMTQSPSSLSASVGDRVTITC<u>RASQSISSYLN</u>WYQQKPGKAPKLLIY<u>AASSLQS</u>GVPSRFSGSGSGTDFTLTISS
LQPEDFATYYC<u>QQSYSTPYT</u>FGQGTKLEIK/RTVAAPSVFIFPPSDEQLKSGTASVVCLLNNFYPREAKVQWKVDNA
LQSGNSQESVT<u>E</u>QDSKDSTYSLSSTLTLSKADYEKHKVYACEVTHQGLSSPVTKSFNRGEC

Figure 123B

<u>XENP30525 2A5B4[TIGIT]_H1L1_Fab-huIL10.107_huIL10.107_(G4S)2-IgG1_pI(-</u>
<u>)_Isosteric_A_PVA_/S267K/L368D/K370S-IgG1_C220S/PVA_/S267K/S364K/E357Q</u>

Chain 1 - 2A5B4[TIGIT]_H1_IgG1_pI(-)_Isosteric_A_PVA_/S267K/L368D/K370S (SEQ ID NO: 931)
EVQLLESGGGLVQPGGSLRLSCAASGFTFSSYAMSWVRQAPGKGLEWVSGISGSGGTTYYADSVKGRFTISRDNSKN
TLYLQMNSLRAEDTAVYYCAKGPVYSARRGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 2 - huIL10.107_huIL10.107_(G4S)2_IgG1_C220S/PVA_/S267K/S364K/E357Q (SEQ ID NO: 932)
*SPGQGTQSENSCTHFPGNLPNMLRDLRDAFSRVKTFFQMKDQLDDLLLKESLLEDFKGYLGCQALSEMIQFYLEEVM*
*PQAENQDPDIKAHVNSLGENLKTLRLRLRRCHRFLPCENKSKAVEQVKNAFNKLQEKGIYKAMSEFDIFINYIEAYM*
*TMKIRNSPGQGTQSENSCTHFPGNLPDMLRDLRDAFSRVKTFFQMKDQLDDLLLKESLLEDFKGYLGCQALSEMIQF*
*YLEEVMPQAENQDPDIKAHVNSLGENLKTLRLRLRRCHRFLPCENKSKAVEQVKNAFNKLQEKGIYKAMSEFDIFIN*
*YIEAYMTMKIR*/GGGGSGGGGS/EPKSSDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQ
VYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK

Chain 3 - 2A5B4[TIGIT]_L1 (SEQ ID NO: 933)
DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

UNTARGETED AND TARGETED IL-10 Fc-FUSION PROTEINS

The application claims the benefit of U.S. Provisional Application No. 62/808,749 filed Feb. 21, 2019 and U.S. Provisional Application No. 62/808,751 filed Feb. 21, 2019, the contents are herein incorporated by reference in their entirety.

SEQUENCE LISTING

The instant application contains a Sequence Listing which has been submitted electronically in ASCII format and is hereby incorporated by reference in its entirety. Said ASCII copy, created on Mar. 31, 2020, is named 067461-5230-US_SL.txt and is 2,370,767 bytes in size.

BACKGROUND OF THE INVENTION

In order for the immune system to mount an effective anti-tumor response, two things must occur. T cells in the tumor environment must first engage antigenic tumor peptides presented by major histocompatibility complexes (MHC) on tumor cells. Next, the T cells must be induced by cytokines such as IL-15 and IL-2 to produce costimulatory cytokines such as IFNγ. Recognition of tumor peptides alone in the absence of cytokine induction leads to T cells becoming anergic, thereby leading to tolerance. Accordingly, a very promising approach in cancer immunotherapy is cytokine-based treatments. In fact, IL-2 has been approved for use in patients with metastatic renal-cell carcinoma and malignant melanoma.

In addition to T cell anergy, tumor cells escape immune response through the downregulation of MHC molecules (Seliger et al., 2002). While interleukin-10 (IL-10) is a cytokine traditionally recognized for its immunoinhibitory properties (Taga, K. and Tosato, G., 1992), it has been found to have immunostimulatory functions in the tumor environment. In line with this, Mumm et al. (2011) reported that IL-10 treatment significantly increases the number of CD8+ T cells in the tumor microenvironment, the expression of IFNγ and granzymes by said intratumoral CD8+ T cells, and expression of intratumoral antigen presentation molecules such as MHC-I and MHC-II, all of which are essential mechanisms for an effector antitumor response.

The biologically functional IL-10 is a domain-swapped homodimer formed by non-covalent interactions between two IL-10 monomers. The biologically functional IL-10 dimer binds the IL-10 receptor which consists of two alpha and two beta subunits (or R1 and R2 subunits). Notably, the IL-10 dimer becomes biologically inactive upon disruption of the interaction between the individual IL-10 monomers. Additionally, as with other cytokines, IL-10 has a short plasma half-life. Rachmawati et al. (2004) reported that human IL-10 injected in rat underwent rapid initial clearance yielding a half-life of 1.7 minutes. Accordingly, in a first aspect, the present invention addresses potential disruption of the biologically functional IL-10 dimer and its short circulatory half-life by providing IL-10 fusion proteins, as well as novel IL-10 variants engineered with decreased potency.

While IL-10 can enhances the immune response, for example in cancer, through stimulation of intratumoral CD8+ T cells, IL-10 can also potentiate inhibition of the immune response through CD4+ regulatory T cells. In line with this, Chan et al. (2015) reported that IL-10 stimulates secretion of IFNγ by CD8+ T cells, incubation of IL-10 with bulk PBMCs actually leads to suppression of IFNγ secretion, suggesting that the immunosuppressive effect of IL-10 is potentiated through non-CD8+ lymphocytes. Further, a high CD8/CD4 T cell ratio in TILs is generally considered a good prognostic marker for tumor therapy. Therefore, in another aspect, the present invention provides CD8-targeted IL-10 fusion proteins.

Immune checkpoint proteins such as PD-1 are up-regulated following T cell activation to preclude autoimmunity by exhausting activated T cells upon binding to immune checkpoint ligands such as PD-L1. However, immune checkpoint proteins are also up-regulated in tumor-infiltrating lymphocytes (TILs), and immune checkpoint ligands are overexpressed on tumor cells, as another mechanism of immune escape by tumor cells. De-repression of TILs by blockade of immune checkpoint interactions by drugs such as Opdivo® (nivolumab) and Keytruda® (pembrolizumab) have proven highly effective in treatment of cancer. Despite the promise of checkpoint blockade therapies such as nivolumab and pembrolizumab, many patients still fail to achieve sufficient response to checkpoint blockade alone. Accordingly, there is a need to identify therapeutic modalities to stack with checkpoint blockade that could increase patient response rate. This can be especially complex as the additional therapeutic modality should not compete with the checkpoint blockade. Therefore, in yet another aspect, the present invention provides PD-1-targeted IL-10 fusion proteins which are selective for TILs expressing PD-1, and which do not compete with checkpoint blockade antibodies with which they may be combined.

BRIEF SUMMARY OF THE INVENTION

In one aspect, the present invention provides a heterodimeric Fc fusion protein comprising: (a) a fusion protein comprising a first protein domain, a second protein domain and a first Fc domain, wherein the first protein domain is covalently attached to the second protein domain, and wherein the second protein domain is covalently attached to the first Fc domain; and (b) a second Fc domain; wherein the first and the second Fc domains comprise modifications promoting heterodimerization of the first and the second Fc domains and wherein the first protein domain comprises a first IL-10 monomer domain and the second protein domain comprises a second IL-10 monomer domain. In some instances, the heterodimeric Fc fusion protein has a single-chain IL-10 hetero-Fc fusion or scIL10-heteroFc format.

In some embodiments, the second protein domain is covalently attached to the N-terminus of the first Fc domain. In certain embodiments, the second protein domain is covalently attached to the C-terminus of the first Fc domain. In some embodiments, the second protein domain is covalently attached to the first Fc domain via a first domain linker. In some embodiments, the first protein domain is attached to the second protein domain via a second domain linker.

In some embodiments, the modifications promoting heterodimerization of the first and the second Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q and T366S/L368A/Y407V: T366W (optionally including a bridging disulfide, T366S/L368A/Y407V/Y349C:T366W/S354C), according to EU numbering. In some embodiments, the first and/or the second Fc domains have an additional set of amino acid substitutions comprising Q295E/N384D/Q418E/N421D, according to EU numbering. In some embodiments, the first and/or the second Fc domains have an additional set of amino acid substitutions consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

In some embodiments, the heterodimeric Fc fusion protein comprises an amino acid modification of G446del/K4447del in the first and/or second Fc domain.

In some embodiments, the second Fc domain and/or second Fc domain comprise a further amino acid substitution selected from the group consisting of M428L, N434S, and M428L/N434S, according to EU numbering.

In some embodiments, the first and/or second IL-10 monomer domain has a polypeptide sequence selected from the group consisting of SEQ ID NO:1 (human IL-10 (109H) precursor sequence), SEQ ID NO:2 (human IL-10 (109L) precursor sequence), SEQ ID NO:3 (human IL-10 (109H) mature form sequence), SEQ ID NO:4 (human IL-10 (109L) mature form sequence), as depicted in FIG. 1.

In some embodiments, the first and/or second IL-10 monomer domain is a variant IL-10 monomer domain. In some embodiments, the variant IL-10 monomer domain comprises an IL-10 monomer domain with one or more amino acid substitutions resulting in altered affinity for an IL-10 receptor, altered potency, altered potential for deamidation, altered potential for aspartic acid isomerization, altered potential for degradation-related PTMs, altered potential degradation sites, altered disulfide bridges, and/or altered potential N-glycosylation sites.

In some embodiments, the variant IL-10 monomer domain comprises one or more amino acid modifications at amino acid residues selected from the group consisting of N21, D28, Q38, M39, D41, Q42, L43, D44, N45, I87, E142, D144, E151, and N160. In some embodiments, the variant IL-10 monomer domain comprises one or more amino acid modifications selected from N21D, D28N, Q38E, M39T, D41N, Q42E, L43V, D44N, N45D, I87A, E142Q, D144N, E151Q, and N160del.

In some embodiments, the first IL-10 monomer domain covalently attached to the second IL-10 monomer domain form a single chain IL-10 comprising SEQ ID NO:23 or SEQ ID NO:23 with amino acid modifications 109L and 269L. In some embodiments, the single chain IL-10 comprises one or more amino acid modifications selected from the group consisting of N21, Q38, D41, N45, D144, E151, N181, Q198, N205, D304, E311, and N320.

In some embodiments, the single chain IL-10 comprises one or more amino acid modifications selected from the group consisting of N21D, Q38E, D41N, N45D, D144N, E151Q, N181D, Q198E, N205D, D304N, E311Q, and N320del. In some embodiments, the single chain IL-10 comprises amino acid modifications selected from N21D/N181D/N320del, N45D/N205D/N320del, Q38E/N45D/N205D/N320del, D41N/N45D/N205D/N320del, N45D/D144N/N205D/N320del, N45D/E151Q/N205D/N320del, N45D/N181D/N205D/N320del, N45D/N205D/D304N/N320del, N21D/N45D/N181D/N205D/N320del, Q38E/N45D/Q198E/N205D/N320del, Q42E/N45D/Q202E/N205D/N320del, and N45D/E151Q/N205D/E311Q/N320del.

In some embodiments, the Fc fusion protein (e.g., scIL10-heteroFc fusion protein) is XENP30005 (SEQ ID NOS:25 and 26), XENP30008 (SEQ ID NOS: 27 and 28) or XENP30013 (SEQ ID NOS: 29 and 30) as depicted in FIGS. 78A-78G.

In some embodiments, the Fc fusion protein is a member selected from XENP25239, XENP25240, and XENP25241 as depicted in FIGS. 21A-21C.

Provided herein is a composition comprising a heterodimeric Fc fusion protein (e.g., scIL10-heteroFc fusion protein) outlined herein for use in treating cancer in a subject. Also, provided herein is one or more nucleic acids encoding a heterodimeric Fc fusion protein outlined herein. Also, provided herein is a host cell comprising the one or more nucleic acids encoding a heterodimeric Fc fusion protein outlined herein.

In another aspect, provided herein is a method of making a heterodimeric Fc fusion protein (e.g., scIL10-heteroFc fusion protein) comprising culturing any host cell described under conditions, whereby the heterodimeric Fc fusion protein is produced; and recovering the heterodimeric Fc fusion protein.

In yet another aspect, provided herein is a method of purifying a heterodimeric Fc fusion protein described herein. The method comprises: (a) providing a composition comprising the heterodimeric Fc fusion protein; (b) loading the composition onto an ion exchange column; and (c) collecting a fraction containing the heterodimeric Fc fusion protein.

In another aspect, the present invention provides a heterodimeric Fc fusion protein comprising: (a) a first fusion protein comprising an antigen binding domain (ABD) and a first Fc domain, wherein the antigen binding domain is attached to the N-terminus of the first Fc domain; and (b) a second fusion protein comprising a first protein domain, a second protein domain and a second Fc domain, wherein the first protein domain is covalently attached to the second protein domain, and wherein the second protein domain is covalently attached to the second Fc domain; wherein the first and the second Fc domains comprise modifications promoting heterodimerization of the first and the second Fc domains, and wherein the first protein domain comprises a first IL-10 monomer domain and the second protein domain comprises a second IL-10 monomer domain. In some instances, the heterodimeric Fc fusion protein has an anti-Xx single-chain IL-10 hetero-Fc fusion or anti-XxscIL10-heteroFc format. In some embodiments, the IL-10 monomer of the scIL10 is linked to the N-terminus or C-terminus of the Fc domain.

In some embodiments, the second protein domain (e.g., second IL-10 monomer domain) is covalently attached to the N-terminus of the second Fc domain. In some embodiments, the second protein domain is covalently attached to the C-terminus of the second Fc domain. In some embodiments, the first protein domain (e.g., first IL-10 monomer domain) is attached to the second protein domain (e.g., second IL-10 monomer) using a first domain linker. In some embodiments, the antigen binding domain is attached to the first Fc domain using a second domain linker.

In some embodiments, the modifications promoting heterodimerization of the first and the second Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q and T366S/L368A/Y407V: T366W (optionally including a bridging disulfide, T366S/L368A/Y407V/Y349C:T366W/S354C), according to EU numbering.

In some embodiments, the first and/or the second Fc domains have an additional set of amino acid substitutions comprising Q295E/N384D/Q418E/N421D, according to EU numbering.

In some embodiments, the first and/or the second Fc domains have an additional set of amino acid substitutions consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

In some embodiments, the first Fc domain and/or the second Fc domain comprise a further amino acid substitution selected from the group consisting of M428L, N434S, and M428L/N434S, according to EU numbering.

In some embodiments, the first and/or the second IL-10 monomer domain comprises a polypeptide sequence selected from the group consisting of SEQ ID NO:1 (human IL-10 (109H) precursor sequence), SEQ ID NO:2 (human IL-10 (109L) precursor sequence), SEQ ID NO:3 (human IL-10 (109H) mature form sequence), SEQ ID NO:4 (human IL-10 (109L) mature form sequence), as depicted in FIG. 1.

In some embodiments, the first IL-10 monomer domain and/or the second IL-10 monomer domain is a variant IL-10 monomer domain.

In some embodiments, the variant IL-10 monomer domain comprises an IL-10 monomer domain with one or more amino acid substitutions resulting in altered affinity for an IL-10 receptor, altered potency, altered potential for deamidation, altered potential for aspartic acid isomerization, altered potential for degradation-related PTMs, altered potential degradation sites, altered disulfide bridges, and/or altered potential N-glycosylation sites.

In some embodiments, the variant IL-10 monomer domain comprises one or more amino acid modifications at amino acid residues selected from the group consisting of N21, D28, Q38, M39, D41, Q42, L43, D44, N45, I87, E142, D144, E151, and N160. In some embodiments, the variant IL-10 monomer domain comprises one or more amino acid modifications selected from N21D, D28N, Q38E, M39T, D41N, Q42E, L43V, D44N, N45D, I87A, E142Q, D144N, E151Q, and N160del.

In some embodiments, the first IL-10 monomer domain covalently attached to the second IL-10 monomer domain form a single chain IL-10 comprising SEQ ID NO:23 or SEQ ID NO:23 with amino acid modifications 109L and 269L. In some embodiments, the single chain IL-10 further comprises one or more amino acid modifications selected from the group consisting of N21, Q38, D41, N45, D144, E151, N181, Q198, N205, D304, E311, and N320. In some embodiments, the single chain IL-10 further comprises one or more amino acid modifications selected from the group consisting of N21D, Q38E, D41N, N45D, D144N, E151Q, N181D, Q198E, N205D, D304N, E311Q, and N320del. In some embodiments, the single chain IL-10 comprises amino acid modifications selected from N21D/N181D/N320del, N45D/N205D/N320del, Q38E/N45D/N205D/N320del, D41N/N45D/N205D/N320del, N45D/D144N/N205D/N320del, N45D/E151Q/N205D/N320del, N45D/N181D/N205D/N320del, N45D/N205D/D304N/N320del, N21D/N45D/N181D/N205D/N320del, Q38E/N45D/Q198E/N205D/N320del, Q42E/N45D/Q202E/N205D/N320del, and N45D/E151Q/N205D/E311Q/N320del.

In some embodiments, the antigen binding domain (ABD) is selected from the group consisting of a PD-1 binding domain, a non-competing PD-1 binding domain, a TIGIT binding domain, a CD8 binding domain, and a NKG2D binding domain.

In some embodiments, the PD-1 binding domain is a humanized PD-1 ABD. In some embodiments, the humanized PD-1 ABD comprises a variable heavy chain and variable light chain pair selected from a group consisting of: 1C11[PD-1]_H0L0, 1C11[P, D-1]_H3L3, 1C11[PD-1]_H3.240_L3.148, 1C11[PD-1]_H3.241_L3.148, 1C11[PD-1]_ H3.234_L3.144, 1C11[PD-1]_H3.241_L3.92, 1C11[PD-1]_H3.303_L3.152, 1C11_H3.329_L3.220, 1C11_H3.328_L3.152, pembrolizumab variable heavy chain and variable light chain, nivolumab variable heavy chain and variable light chain, pidilizumab variable heavy chain and variable light chain, MK-3475 variable heavy chain and variable light chain, BAP049 Clone E variable heavy chain and variable light chain, BAP049 Clone B variable heavy chain and variable light chain, H7798N[PD-1] variable heavy chain and variable light chain, h1H3 Var 6[PD-1] variable heavy chain and variable light chain, APE2058[PD-1] variable heavy chain and variable light chain, H005-1[PD-1] variable heavy chain and variable light chain, 317-4B6[PD-1] variable heavy chain and variable light chain, 326-4A3[PD-1] variable heavy chain and variable light chain, hPD-1 mAb 7 (1.2)[PD-1] variable heavy chain and variable light chain, Clone 38[PD-1] variable heavy chain and variable light chain, Clone 39[PD-1] variable heavy chain and variable light chain, Clone 41[PD-1] variable heavy chain and variable light chain, Clone 48[PD-1] variable heavy chain and variable light chain, PD1-17[PD-1] variable heavy chain and variable light chain, PD1-28[PD-1] variable heavy chain and variable light chain, PD1-33[PD-1] variable heavy chain and variable light chain, PD1-35[PD-1] variable heavy chain and variable light chain, LOPD180 variable heavy chain and variable light chain, Ab948 variable heavy chain and variable light chain, humanized EH-12.2H7[PD-1] variable heavy chain and variable light chain, RG1H10 variable heavy chain and variable light chain, RG1H10-H2A-22-1S variable heavy chain and variable light chain, RG1H10-H2A-27-2S variable heavy chain and variable light chain, RG1H10-3C variable heavy chain and variable light chain, RG1H10-16C variable heavy chain and variable light chain, RG1H10-17C variable heavy chain and variable light chain, RG1H10-19C variable heavy chain and variable light chain, RG1H10-21C variable heavy chain and variable light chain, RG1H10-23C2 variable heavy chain and variable light chain, mAb7[PD-1], and PD1AB-6[PD-1] variable heavy chain and variable light chain, as depicted in FIGS. 100A-100G.

In some embodiments, the heterodimeric Fc fusion protein that binds PD-1 (e.g., anti-PD-1×scIL10-hetero Fc) is a member selected from the group consisting of: XENP25953, XENP27830, and XENP27831.

In some embodiments, the non-competing PD-1 binding domain is a humanized non-competing PD1 ABD that does not bind the same epitope as nivolumab and/or pembrolizumab. In some embodiments, the humanized non-competing PD-1 ABD comprises a variable heavy chain and variable light chain pair selected from a group consisting of: mAb A[PD-1]_H1_L1, mAb B[PD-1]_H1_L1, mAb C[PD-1]_H1_L1, mAb C[PD-1]_H1_L1.1, mAb C[PD-1]_H1_L1.3, mAb C[PD-1]_H1_L1.45, mAb C[PD-1]_H1_L1.117, mAb C[PD-1]_H1_L1.129, mAb C[PD-1]_H1_L1.135, mAb C[PD-1]_H1_L1.136, mAb C[PD-1]_H1_L1.140, mAb C[PD-1]_H1_L2, mAb C[PD-1]_H1.19_11, mAb C[PD-1]_H1.19_L1.1, mAb C[PD-1]_H1.19_L1.3, mAb C[PD-1]_H1.19_L1.45, mAb C[PD-1]

_H1.19_L1.117, mAb C[PD-1]_H1.19_L1.129, mAb C[PD-1]_H1.19_L1.135, mAb C[PD-1]_H1.19_L1.136, mAb C[PD-1]_H1.19_L1.140, mAb C[PD-1]_H1.19_L2, mAb C[PD-1]_H1.48_11, mAb C[PD-1]_H1.48_L1.1, mAb C[PD-1]_H1.48_L1.3, mAb C[PD-1]_H1.48_L1.45, mAb C[PD-1]_H1.48_L1.117, mAb C[PD-1]_H1.48_L1.129, mAb C[PD-1]_H1.48_L1.135, mAb C[PD-1]_H1.48_L1.136, mAb C[PD-1]_H1.48_L1.140, mAb C[PD-1]_H1.48_L2, mAb C[PD-1]_H1.125_11, mAb C[PD-1]_H1.125_L1.1, mAb C[PD-1]_H1.125_L1.3, mAb C[PD-1]_H1.125_L1.45, mAb C[PD-1]_H1.125_L1.117, mAb C[PD-1]_H1.125_L1.129, mAb C[PD-1]_H1.125_L1.135, mAb C[PD-1]_H1.125_L1.136, mAb C[PD-1]_H1.125_L1.140, mAb C[PD-1]_H1.125_L2, mAb C[PD-1]_H1.130_11, mAb C[PD-1]_H1.130_L1.1, mAb C[PD-1]_H1.130_L1.3, mAb C[PD-1]_H1.130_L1.45, mAb C[PD-1]_H1.130_L1.117, mAb C[PD-1]_H1.130_L1.129, mAb C[PD-1]_H1.130_L1.135, mAb C[PD-1]_H1.130_L1.136, mAb C[PD-1]_H1.130_L1.140, mAb C[PD-1]_H1.130_L2, mAb C[PD-1]_H1.132_11, mAb C[PD-1]_H1.132_L1.1, mAb C[PD-1]_H1.132_L1.3, mAb C[PD-1]_H1.132_L1.45, mAb C[PD-1]_H1.132_L1.117, mAb C[PD-1]_H1.132_L1.129, mAb C[PD-1]_H1.132_L1.135, mAb C[PD-1]_H1.132_L1.136, mAb C[PD-1]_H1.132_L1.140, mAb C[PD-1]_H1.132_L2, mAb C[PD-1]_H1.169_11, mAb C[PD-1]_H1.169_L1.1, mAb C[PD-1]_H1.169_L1.3, mAb C[PD-1]_H1.169_L1.45, mAb C[PD-1]_H1.169_L1.117, mAb C[PD-1]_H1.169_L1.129, mAb C[PD-1]_H1.169_L1.135, mAb C[PD-1]_H1.169_L1.136, mAb C[PD-1]_H1.169_L1.140, mAb C[PD-1]_H1.169_L2, mAb C[PD-1]_H1.175_11, mAb C[PD-1]_H1.175_L1.1, mAb C[PD-1]_H1.175_L1.3, mAb C[PD-1]_H1.175_L1.45, mAb C[PD-1]_H1.175_L1.117, mAb C[PD-1]_H1.175_L1.129, mAb C[PD-1]_H1.175_L1.135, mAb C[PD-1]_H1.175_L1.136, mAb C[PD-1]_H1.175_L1.140, mAb C[PD-1]_H1.175_L2, mAb C[PD-1]_H2_L1, mAb C[PD-1]_H2_L1.1, mAb C[PD-1]_H2_L1.3, mAb C[PD-1]_ H2_L1.45, mAb C[PD-1]_H2_L1.117, mAb C[PD-1]_ H2_L1.129, mAb C[PD-1]_H2_L1.135, mAb C[PD-1]_ H2_L1.136, mAb C[PD-1]_H2_L1.140, and mAb C[PD-1]_ H2_L2, as depicted in FIGS. 104A-104B.

In some embodiments, the CD8 binding domain is a humanized CD8 ABD. In some embodiments, the humanized CD8 ABD comprises a variable heavy chain and variable light chain pair selected from a group consisting OKT8_H2L1 and 1C11B3_H1L1, as depicted in FIG. 92.

In some embodiments, the NKG2D binding domain is a humanized NKG2D ABD. In some embodiments, the humanized NKG2D ABD comprises a variable heavy chain and variable light chain pair selected from a group consisting MS[NKG2D] H0_L0, 1D7B4[NKG2D]_H1_L1, KYK-1.0[NKG2D]_H1_L1, KYK-2.0[NKG2D]_H0_L0, 11B2D10[NKG2D]_H0_L0, 6E5A7[NKG2D]_H0_L0, 6H7E7[NKG2D]_H0_L0, mAb E[NKG2D]_H1_L1, 16F31 [NKG2D]_H1_L1, mAb D[NKG2D]_H1_L1, 1 D7B4 [NKG2D]_H1_L1, mAb A[NKG2D]_H1_L1, mAb A[NKG2D]_H2_L1, mAb A[NKG2D]_H1_L2, mAb A[NKG2D]_H2_L2, mAb B[NKG2D]_H1_L1, mAb B[NKG2D]_H1_L1.1, mAb B[NKG2D]_H1_L2, mAb B[NKG2D]_H2_L1, mAb B[NKG2D]_H2_L1.1, mAb B[NKG2D]_H2_L2, mAb B[NKG2D]_H3_L1, mAb B[NKG2D]_H3_L1.1, mAb B[NKG2D]_H3_L2, mAb C[NKG2D]_H1_L1, mAb C[NKG2D]_H2_L1, mAb C[NKG2D]_H1_L2, and mAb C[NKG2D]_H2_L2, as depicted in FIGS. 93A-93C.

Provided herein is a composition comprising a heterodimeric Fc fusion protein (e.g., anti-XxscIL10-heteroFc fusion protein) described for use in treating cancer in a subject. Also, provided is one or more nucleic acids encoding any of the heterodimeric Fc fusion proteins described herein. Also, provided is a host cell comprising one or more nucleic acids encoding any of the heterodimeric Fc fusion proteins described herein.

In one aspect, provided is a method of making a heterodimeric Fc fusion protein e.g., anti-XxscIL10-heteroFc fusion protein) comprising culturing a host cell described herein under conditions whereby the heterodimeric Fc fusion protein is produced; and recovering the protein.

In another aspect, provided is a method of purifying a heterodimeric Fc fusion protein (e.g., anti-XxscIL10-heteroFc fusion protein) described herein. The method comprises: (a) providing a composition comprising the heterodimeric Fc fusion protein; (b) loading the composition onto an ion exchange column; and (c) collecting a fraction containing the heterodimeric Fc fusion protein.

In yet another aspect, the present invention provides a heterodimeric Fc fusion protein comprising: (a) a first fusion protein comprising a first antigen binding domain and a first Fc domain, wherein the first antigen binding domain (ABD) is covalently attached to the N-terminus of the first Fc domain; and (b) a second fusion protein comprising a second antigen binding domain (ABD), a second Fc domain, a first protein domain and a second protein domain, wherein the second antigen binding domain is covalently attached to the N-terminus of the second Fc domain, wherein the first protein domain is covalently attached to the second protein domain, and wherein the second protein domain is covalently attached to the C-terminus of the second Fc domain; wherein the first and the second Fc domains comprise modifications promoting heterodimerization of the first and the second Fc domains, and wherein the first protein domain comprises a first IL-10 monomer domain and the second protein domain comprises a second IL-10 monomer domain. In some instances, the heterodimeric Fc fusion protein has an (anti-X)2x heteroFc-single chain IL-10 fusion or (anti-X)2-heteroFc-scIL10 fusion format.

In some embodiments, the modifications promoting heterodimerization of the first and the second Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q and T366S/L368A/Y407V: T366W (optionally including a bridging disulfide, T366S/L368A/Y407V/Y349C:T366W/S354C), according to EU numbering.

In some embodiments, the first and/or the second Fc domains have an additional set of amino acid substitutions comprising Q295E/N384D/Q418E/N421D, according to EU numbering.

In some embodiments, the first and/or the second Fc domains have an additional set of amino acid substitutions consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

In some embodiments, the first Fc domain and/or the second Fc domain comprise a further amino acid substitution selected from the group consisting of M428L, N434S, and M428L/N434S, according to EU numbering.

In some embodiments, the first and/or the second IL-10 monomer domain comprises a polypeptide sequence selected from the group consisting of SEQ ID NO:1 (human IL-10 (109H) precursor sequence), SEQ ID NO:2 (human IL-10 (109L) precursor sequence), SEQ ID NO:3 (human IL-10 (109H) mature form sequence), SEQ ID NO:4 (human IL-10 (109L) mature form sequence), as depicted in FIG. 1.

In some embodiments, the first IL-10 monomer domain and/or the second IL-10 monomer domain is a variant IL-10 monomer domain.

In some embodiments, the variant IL-10 monomer domain comprises an IL-10 monomer domain with one or more amino acid substitutions resulting in altered affinity for an IL-10 receptor, altered potency, altered potential for deamidation, altered potential for aspartic acid isomerization, altered potential for degradation-related PTMs, altered potential degradation sites, altered disulfide bridges, and/or altered potential N-glycosylation sites.

In some embodiments, the variant IL-10 monomer domain comprises one or more amino acid modifications at amino acid residues selected from the group consisting of N21, D28, Q38, M39, D41, Q42, L43, D44, N45, I87, E142, D144, E151, and N160. In some embodiments, the variant IL-10 monomer domain comprises one or more amino acid modifications selected from N21D, D28N, Q38E, M39T, D41N, Q42E, L43V, D44N, N45D, I87A, E142Q, D144N, E151Q, and N160del.

In some embodiments, the first IL-10 monomer domain covalently attached to the second IL-10 monomer domain form a single chain IL-10 comprising SEQ ID NO:23 or SEQ ID NO:23 with amino acid modifications 109L and 269L.

In some embodiments, the single chain IL-10 further comprises one or more amino acid modifications selected from the group consisting of N21, Q38, D41, N45, D144, E151, N181, Q198, N205, D304, E311, and N320. In some embodiments, the single chain IL-10 further comprises one or more amino acid modifications selected from the group consisting of N21D, Q38E, D41N, N45D, D144N, E151Q, N181D, Q198E, N205D, D304N, E311Q, and N320del. In some embodiments, the single chain IL-10 comprises amino acid modifications selected from N21D/N181D/N320del, N45D/N205D/N320del, Q38E/N45D/N205D/N320del, D41N/N45D/N205D/N320del, N45D/D144N/N205D/N320del, N45D/E151Q/N205D/N320del, N45D/N181D/N205D/N320del, N45D/N205D/D304N/N320del, N21D/N45D/N181D/N205D/N320del, Q38E/N45D/Q198E/N205D/N320del, Q42E/N45D/Q202E/N205D/N320del, and N45D/E151Q/N205D/E311Q/N320del.

In some embodiments, the first ABD and/or the second ABD is selected from the group consisting of a PD-1 binding domain, a non-competing PD-1 binding domain, a TIGIT binding domain, a CD8 binding domain, and a NKG2D binding domain.

In some embodiments, the PD-1 binding domain is a humanized PD-1 ABD. In some embodiments, the humanized PD-1 ABD comprises a variable heavy chain and variable light chain pair selected from the group consisting of: 1C11[PD-1]_H0L0, 1C11[P, D-1]_H3L3, 1C11[PD-1]_H3.240_L3.148, 1C11[PD-1]_H3.241_L3.148, 1C11[PD-1]_ H3.234_L3.144, 1C11[PD-1]_H3.241_L3.92, 1C11 [PD-1]_H3.303_L3.152, 1C11_H3.329_L3.220, 1C11_H3.328_L3.152, pembrolizumab variable heavy chain and variable light chain, nivolumab variable heavy chain and variable light chain, pidilizumab variable heavy chain and variable light chain, MK-3475 variable heavy chain and variable light chain, BAP049 Clone E variable heavy chain and variable light chain, BAP049 Clone B variable heavy chain and variable light chain, H7798N[PD-1] variable heavy chain and variable light chain, h1H3 Var 6[PD-1] variable heavy chain and variable light chain, APE2058[PD-1] variable heavy chain and variable light chain, H005-1[PD-1] variable heavy chain and variable light chain, 317-4B6[PD-1] variable heavy chain and variable light chain, 326-4A3[PD-1] variable heavy chain and variable light chain, hPD-1 mAb 7 (1.2)[PD-1] variable heavy chain and variable light chain, Clone 38[PD-1] variable heavy chain and variable light chain, Clone 39[PD-1] variable heavy chain and variable light chain, Clone 41[PD-1] variable heavy chain and variable light chain, Clone 48[PD-1] variable heavy chain and variable light chain, PD1-17 [PD-1] variable heavy chain and variable light chain, PD1-28[PD-1] variable heavy chain and variable light chain, PD1-33[PD-1] variable heavy chain and variable light chain, PD1-35[PD-1] variable heavy chain and variable light chain, LOPD180 variable heavy chain and variable light chain, Ab948 variable heavy chain and variable light chain, humanized EH-12.2H7[PD-1] variable heavy chain and variable light chain, RG1H10 variable heavy chain and variable light chain, RG1H10-H2A-22-1S variable heavy chain and variable light chain, RG1H10-H2A-27-2S variable heavy chain and variable light chain, RG1H10-3C variable heavy chain and variable light chain, RG1H10-16C variable heavy chain and variable light chain, RG1H10-17C variable heavy chain and variable light chain, RG1H10-19C variable heavy chain and variable light chain, RG1H10-21C variable heavy chain and variable light chain, RG1H10-23C2 variable heavy chain and variable light chain, mAb7 [PD-1], and PD1AB-6[PD-1] variable heavy chain and variable light chain, as depicted in FIGS. 100A-100G.

In some embodiments, the non-competing PD-1 binding domain is a humanized non-competing PD1 ABD that does not bind the same epitope as nivolumab and/or pembrolizumab. In some embodiments, the humanized non-competing PD-1 ABD comprises a variable heavy chain and variable light chain pair selected from a group consisting of: mAb A[PD-1]_H1_L1, mAb B[PD-1]_H1_L1, mAb C[PD-1]_H1_L1, mAb C[PD-1]_H1_L1.1, mAb C[PD-1]_ H1_L1.3, mAb C[PD-1]_H1_L1.45, mAb C[PD-1]_ H1_L1.117, mAb C[PD-1]_H1_L1.129, mAb C[PD-1]_ H1_L1.135, mAb C[PD-1]_H1_L1.136, mAb C[PD-1]_ H1_L1.140, mAb C[PD-1]_H1_L2, mAb C[PD-1]_ H1.19_11, mAb C[PD-1]_H1.19_L1.1, mAb C[PD-1] H1.19_L1.3, mAb C[PD-1]_H1.19_L1.45, mAb C[PD-1]_ H1.19_L1.117, mAb C[PD-1]_H1.19_L1.129, mAb C[PD-1]_H1.19_L1.135, mAb C[PD-1]_H1.19_L1.136, mAb C[PD-1]_H1.19_L1.140, mAb C[PD-1]_H1.19_L2, mAb C[PD-1]_H1.48_11, mAb C[PD-1]_H1.48_L1.1, mAb C[PD-1]_H1.48_L1.3, mAb C[PD-1]_H1.48_L1.45, mAb C[PD-1]_H1.48_L1.117, mAb C[PD-1]_H1.48_L1.129, mAb C[PD-1]_H1.48_L1.135, mAb C[PD-1]_ H1.48_L1.136, mAb C[PD-1]_H1.48_L1.140, mAb C[PD-1]_H1.48_L2, mAb C[PD-1]_H1.125_11, mAb C[PD-1]_ H1.125_L1.1, mAb C[PD-1]_H1.125_L1.3, mAb C[PD-1]_ H1.125_L1.45, mAb C[PD-1]_H1.125_L1.117, mAb C[PD-1]_H1.125_L1.129, mAb C[PD-1]_ H1.125_L1.135, mAb C[PD-1]_H1.125_L1.136, mAb C[PD-1]_H1.125_L1.140, mAb C[PD-1]_H1.125_L2, mAb C[PD-1]_H1.130_11, mAb C[PD-1]_H1.130_L1.1, mAb C[PD-1]_H1.130_L1.3, mAb C[PD-1]_H1.130_L1.45, mAb C[PD-1]_ H1.130_L1.117, mAb C[PD-1]_H1.130_L1.129, mAb C[PD-1]_H1.130_L1.135, mAb C[PD-1]_H1.130_L1.136, mAb C[PD-1]_H1.130_L1.140, mAb C[PD-1]_H1.130_L2, mAb C[PD-1]_H1.132_11, mAb C[PD-1]_H1.132_L1.1, mAb C[PD-1]_H1.132_L1.3, mAb C[PD-1]_H1.132_L1.45, mAb C[PD-1]_H1.132_L1.117, mAb C[PD-1]_H1.132_L1.129, mAb C[PD-1]_H1.132_L1.135, mAb C[PD-1]_H1.132_L1.136, mAb C[PD-1]_H1.132_L1.140, mAb C[PD-1]_H1.132_L2, mAb C[PD-1]_H1.169_11, mAb C[PD-1]_H1.169_L1.1, mAb C[PD-1]_H1.169_L1.3, mAb C[PD-1]_H1.169_L1.45, mAb C[PD-1]_H1.169_L1.117, mAb C[PD-1]_H1.169_L1.129, mAb C[PD-1]_H1.169_L1.135, mAb C[PD-1]_H1.169_L1.136, mAb C[PD-1]_H1.169_L1.140, mAb C[PD-1]_H1.169_L2, mAb C[PD-1]_H1.175_11, mAb C[PD-1]_H1.175_L1.1, mAb C[PD-1]_H1.175_L1.3, mAb C[PD-1]_H1.175_L1.45, mAb C[PD-1]_H1.175_L1.117, mAb C[PD-1]_H1.175_L1.129, mAb C[PD-1]_H1.175_L1.135, mAb C[PD-1]_H1.175_L1.136, mAb C[PD-1]_H1.175_L1.140, mAb C[PD-1]_H1.175_L2, mAb C[PD-1]_H2_L1, mAb C[PD-1]_H2_L1.1, mAb C[PD-1]_H2_L1.3, mAb C[PD-1]_ H2_L1.45, mAb C[PD-1]_H2_L1.117, mAb C[PD-1]_H2_L1.129, mAb C[PD-1]_H2_L1.135, mAb C[PD-1]_H2_L1.136, mAb C[PD-1]_H2_L1.140, and mAb C[PD-1]_H2_L2, as depicted in FIGS. 104A-104B.

In some embodiments, the CD8 binding domain is a humanized CD8 ABD. In some embodiments, the humanized CD8 ABD comprises a variable heavy chain and variable light chain pair selected from a group consisting OKT8_H2L1 and 1C11B3_H1L1, as depicted in FIG. 92.

In some embodiments, the NKG2D binding domain is a humanized NKG2D ABD. In some embodiments, the humanized NKG2D ABD comprises a variable heavy chain and variable light chain pair selected from a group consisting MS[NKG2D] H0_L0, 1D7B4[NKG2D]_H1_L1, KYK-1.0[NKG2D]_H1_L1, KYK-2.0[NKG2D]_H0_L0, 11B2D10[NKG2D]_H0_L0, 6E5A7[NKG2D]_H0_L0, 6H7E7[NKG2D]_H0_L0, mAb E[NKG2D]_H1_L1, 16F31 [NKG2D]_H1_L1, mAb D[NKG2D]_H1_L1, 1 D7B4 [NKG2D]_H1_L1, mAb A[NKG2D]_H1_L1, mAb A[NKG2D]_H2_L1, mAb A[NKG2D]_H1_L2, mAb A[NKG2D]_H2_L2, mAb B[NKG2D]_H1_L1, mAb B[NKG2D]_H1_L1.1, mAb B[NKG2D]_H1_L2, mAb B[NKG2D]_H2_L1, mAb B[NKG2D]_H2_L1.1, mAb B[NKG2D]_H2_L2, mAb B[NKG2D]_H3_L1, mAb B[NKG2D]_H3_L1.1, mAb B[NKG2D]_H3_L2, mAb C[NKG2D]_H1_L1, mAb C[NKG2D]_H2_L1, mAb C[NKG2D]_H1_L2, and mAb C[NKG2D]_H2_L2, as depicted in FIGS. 93A-93C.

Provided is a composition comprising any of the heterodimeric Fc fusion proteins (e.g., anti-X)2-heteroFc-scIL10 fusions) outlined herein for use in treating cancer in a subject. Also provided is one or more nucleic acids encoding any of the heterodimeric Fc fusion proteins outlined herein. Also provided is a host cell comprising one or more nucleic acids encoding any of the heterodimeric Fc fusion proteins outlined herein.

In one aspect, provided is a method of making any of the heterodimeric Fc fusion proteins (e.g., anti-X)2-heteroFc-scIL10 fusions) outlined herein comprising culturing a host cell as outlined under conditions whereby the heterodimeric Fc fusion protein is produced; and recovering the protein.

In yet another aspect, the present invention provides a dimeric Fc fusion protein comprising: (a) a first fusion protein comprising a first IL-10 monomer domain and a first Fc domain, wherein the IL-10 monomer domain is covalently attached to the first Fc domain; and (b) a second fusion protein comprising a second IL-10 monomer domain and a second Fc domain, wherein the second IL-10 monomer domain is covalently attached the second Fc domain. In some embodiments, the dimeric Fc fusion has a (IL-10)2-Fc fusion format.

In some embodiments, the first and second fusion proteins are identical. In some embodiments, the first IL-10 monomer domain and the second IL-10 monomer domain are identical.

In some embodiments, the first and/or second Fc domains comprise a set of amino acid substitutions selected from the group consisting of C219S, C220S, S228P, G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236, and E233P/L234V/L235A/G236_/S267K, according to EU numbering.

In some embodiments, the first and/or the second Fc domains have an additional set of amino acid substitutions comprising Q295E/N384D/Q418E/N421D, according to EU numbering.

In some embodiments, the first and/or the second Fc domains have an additional set of amino acid substitutions consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

In some embodiments, the first and/or second Fc domains comprise a further amino acid substitution selected from the group consisting of M428L, N434S, and M428L/N434S, according to EU numbering.

In some embodiments, the first IL-10 monomer domain is covalently attached to the N-terminus of the first Fc domain and the second IL-10 monomer domain is covalently attached to the N-terminus of the second Fc domain. In certain embodiments, the e first IL-10 monomer domain is covalently attached to the C-terminus of the first Fc domain and the second IL-10 monomer domain is covalently attached to the C-terminus of the second Fc domain.

In some embodiments, the first IL-10 monomer domain is attached to the first Fc domain using a first domain linker and/or the second IL-10 monomer domain is attached to the second Fc domain using a second domain linker. In particular embodiments, the first IL-10 monomer domain is attached to the first Fc domain using a first domain linker and the second IL-10 monomer domain is attached to the second Fc domain using a second domain linker. In further embodiments, the first IL-10 monomer domain is attached to the first Fc domain using a first domain linker. In yet further embodiments, the second IL-10 monomer domain is attached to the second Fc domain using a second domain linker.

In some embodiments, the first IL-10 monomer domain and/or the second IL-10 monomer domain have a leucine at position 109 rather than a histidine. In other words, in some embodiments the first IL-10 monomer domain has a leucine at position 109 rather than a histidine. In some embodiments, the second IL-10 monomer domain has a leucine at position 109 rather than a histidine. In some embodiments, the first IL-10 monomer domain and the second IL-10 monomer domain have a leucine at position 109 rather than a histidine In some embodiments, the first IL-10 monomer domain and/or the second IL-10 monomer domain have a histidine at position 109 rather than a leucine. In other words, in some embodiments the first IL-10 monomer domain and the second IL-10 monomer domain have a histidine at position 109 rather than a leucine. In certain embodiments, the first IL-10 monomer domain has a histidine at position 109 rather than a leucine. In other embodiments, the second IL-10 monomer domain has a histidine at position 109 rather than a leucine.

In some embodiments, the first and/or second IL-10 monomer domains comprise a polypeptide sequence selected from the group consisting of SEQ ID NO:1 (human IL-10 (109H) precursor sequence), SEQ ID NO:2 (human IL-10 (109L) precursor sequence), SEQ ID NO:3 (human IL-10 (109H) mature form sequence), SEQ ID NO: 4 (human IL-10 (109L) mature form sequence). In some embodiments, the first IL-10 monomer domain comprises a polypeptide sequence selected from the group consisting of SEQ ID NO:1 (human IL-10 (109H) precursor sequence), SEQ ID NO:2 (human IL-10 (109L) precursor sequence), SEQ ID NO:3 (human IL-10 (109H) mature form sequence), SEQ ID NO: 4 (human IL-10 (109L) mature form sequence). In certain embodiments, the second IL-10 monomer domain comprises a polypeptide sequence selected from the group consisting of SEQ ID NO:1 (human IL-10 (109H) precursor sequence), SEQ ID NO:2 (human IL-10 (109L) precursor sequence), SEQ ID NO:3 (human IL-10 (109H) mature form sequence), SEQ ID NO: 4 (human IL-10 (109L) mature form sequence).

In some embodiments, the first and/or second IL-10 monomer domain is a variant IL-10 monomer domain. In some embodiments, the first IL-10 monomer domain is a variant IL-10 monomer domain. In some embodiments, the second IL-10 monomer domain is a variant IL-10 monomer domain.

In some embodiments, the variant IL-10 monomer domain comprises one or more amino acid modifications at amino acid residues selected from the group consisting of N21, D28, Q38, M39, D41, Q42, L43, D44, N45, I87, E142, D144, E151, and N160. In some embodiments, the variant IL-10 monomer domain comprises one or more amino acid modifications selected from the group consisting of N21D, D28N, Q38E, M39T, D41N, Q42E, L43V, D44N, N45D, I87A, E142Q, D144N, E151Q, and N160del.

In some embodiments, the first and second fusion protein of the (IL-10)2-Fc fusion format each comprises a polypeptide sequence selected from the group consisting of: XENP24628, XENP24629, XENP24630, XENP24631, XENP24632, XENP24633, and XENP24634 as depicted in FIGS. 17-18.

In one aspect, the present invention provides a heterodimeric Fc fusion protein comprising: a) a first fusion protein comprising a first IL-10 monomer domain and a first Fc domain, wherein the first IL-10 monomer domain is covalently attached to the first Fc domain; and (b) a second Fc domain; wherein the first and the second Fc domains comprise modifications promoting heterodimerization of the first and the second Fc domains. In some embodiments, the heterodimeric Fc fusion protein has a (IL10-NC-IL10)-heteroFc fusion format.

In some embodiments, the heterodimeric Fc fusion protein further comprises a second IL-10 monomer domain non-covalently attached to the first IL-10 monomer domain. In some embodiments, the first IL-10 monomer domain is attached to the N-terminus of the first Fc domain. In some embodiments, the first IL-10 monomer domain is attached to the C-terminus of the first Fc domain. In some embodiments, the first IL-10 monomer domain is attached to the first Fc domain using a first domain linker.

In some embodiments, the modifications promoting heterodimerization of the first and second Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q and T366S/L368A/Y407V: T366W (optionally including a bridging disulfide, T366S/L368A/Y407V/Y349C:T366W/S354C), according to EU numbering.

In some embodiments, the first and/or the second Fc domains has an additional set of amino acid substitutions comprising Q295E/N384D/Q418E/N421D, according to EU numbering.

In some embodiments, the first and/or the second Fc domains have an additional set of amino acid substitutions consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

In some embodiments, the first and/or second Fc domains comprise a further amino acid substitution selected from the group consisting of M428L, N434S, and M428L/N434S, according to EU numbering.

In some embodiments, the first and/or second IL-10 monomer domain has a polypeptide sequence selected form the group consisting of SEQ ID NO:1 (human IL-10 (109H) precursor sequence), SEQ ID NO:2 (human IL-10 (109L) precursor sequence), SEQ ID NO:3 (human IL-10 (109H) mature form sequence), SEQ ID NO:4 (human IL-10 (109L) mature form sequence).

In some embodiments, the first and/or second IL-10 monomer domain is a variant IL-10 monomer domain. In some embodiments, the variant IL-10 monomer domain comprises an IL-10 monomer domain with one or more amino acid substitutions resulting in altered affinity for an IL-10 receptor, altered potency, altered potential for deamidation, altered potential for aspartic acid isomerization, altered potential for degradation-related PTMs, altered potential degradation sites, altered disulfide bridges, and/or altered potential N-glycosylation sites.

In some embodiments, the variant IL-10 monomer domain comprises one or more amino acid modifications at amino acid residues selected from the group consisting of N21, D28, Q38, M39, D41, Q42, L43, D44, N45, I87, E142, D144, E151, and N160. In some embodiments, the variant IL-10 monomer domain comprises one or more amino acid modifications selected from the group consisting of N21D, D28N, Q38E, M39T, D41N, Q42E, L43V, D44N, N45D, I87A, E142Q, D144N, E151Q, and N160del.

In yet another aspect, the present invention provides a dimeric Fc fusion protein comprising: (a) a first fusion protein comprising a first protein domain and a first Fc domain, wherein the first protein domain is covalently attached to the first Fc domain; (b) a second fusion protein comprising a second protein domain and a second Fc domain, wherein the second protein domain is covalently attached to the second Fc domain; wherein the first protein domain comprises a first IL-10 monomer domain comprising an insert peptide and the second protein domain comprises a second IL-10 monomer domain comprising an insert peptide. Such a dimeric Fc fusion protein has a (IL10M1)2-Fc fusion format.

In some embodiments, the first protein domain is covalently attached to the N-terminus of the first Fc domain and/or the second protein domain is covalently attached to the N-terminus of the second Fc domain. In some embodiments, the first protein domain is covalently attached to the C-terminus of the first Fc domain and/or the second protein domain is covalently attached to the C-terminus of the second Fc domain. In some embodiments, the first protein domain is covalently attached to the first Fc domain via a first domain linker. In some embodiments, the second protein domain is covalently attached to the second Fc domain via a second domain linker.

In some embodiments, the first Fc domain and/or the second Fc domain comprise a further amino acid substitution selected from the group consisting of M428L, N434S, and M428L/N434S, according to EU numbering.

In some embodiments, the insert peptide comprises a domain linker engineered between helices D and E of an IL-10 monomer domain.

In some embodiments, the first IL-10 monomer domain and/or the second IL-10 monomer domain comprises a polypeptide sequence selected from the group consisting of SEQ ID NO:24 (IL10M1) as depicted in FIG. 15D and huIL10M1 variants as depicted in FIGS. 75A-75B.

In some embodiments, the first IL-10 monomer domain and/or the second IL-10 monomer domain comprises a variant IL-10 domain comprising one or more amino acid modifications selected from the group consisting of N21D, D28N, Q38E, M39T, D41N, Q42E, L43V, D44N, N45D, I87A, E142Q, D144N, E151Q, C12A, C108A, Q38E/D41N, Q38E/Q42E, Q38E/N45D, Q38E/E142Q, Q38E/D144N, D41N/Q42E, D41N/N45D, D41N/E142Q, D41N/D144N, Q42E/N45D, Q42E/E142Q, Q42E/D144N, N45D/E142Q, N45D/D144N, E142Q/D144N, N21D/Q42E, N21D/N45D, N21D/E151Q, N21D/N45E, Q42E/E151Q, N45D/E151Q, N21D/Q42E/N45D, N21D/Q42E/E151Q, Q42E/N45D/ E151Q, N21D/Q42E/N45E, N21D/Q42E/N45D/E151Q, F37C/M140C, Q38C/S141C, D41C/K138C, L47C/K138C, L48C/E142C, S51C/A120C, D55C/A120C, F56C/Y153C, C62A/C114A, A64C/S118C, M68C/V121C, V76C/A139C, L47Q, S118A, and A139Q.

In some embodiments, the first fusion protein and the second fusion protein are identical. In some embodiments, the first fusion protein and the second fusion protein of the (IL10M1)2-Fc fusion each comprise a polypeptide sequence of XENP25236 as depicted in FIG. 26. In some embodiments, the first fusion protein and the second fusion protein of the (IL10M1)2-Fc fusion each comprise a polypeptide sequence of XENP25237 as depicted in FIG. 27.

In another aspect, the present invention provides a heterodimeric Fc fusion protein comprising: (a) a fusion protein comprising a first protein domain, a second protein domain and a first Fc domain, wherein the first protein domain is attached to the first Fc domain, and wherein the second protein domain is covalently attached to the first protein domain; and (b) a second Fc domain; wherein the first and the second Fc domains comprise modifications promoting heterodimerization of the first and the second Fc domains, and wherein the first protein domain comprises a first IL10 monomer and the second protein domain comprises a second IL10 monomer, and wherein each of the first and second IL10 monomer comprises an insert peptide. The heterodimeric Fc fusion protein has an (IL10M1)2-heteroFc fusion format.

In some embodiments, the first protein domain is attached to the N-terminus of the first Fc domain. In some embodiments, the first protein domain is attached to the C-terminus of the first Fc domain. In some embodiments, the first protein domain is attached to the second protein domain using a first domain linker and/or the first protein domain is attached to the first Fc domain using a second domain linker.

In some embodiments, the modifications promoting heterodimerization of the first and the second Fc domains are a set of amino acid substitutions selected from the group consisting of L368D/K370S and S364K; L368D/K370S and S364K/E357L; L368D/K370S and S364K/E357Q; T411E/ K360E/Q362E and D401K; L368E/K370S and S364K; K370S and S364K/E357Q and T366S/L368A/Y407V: T366W (optionally including a bridging disulfide, T366S/ L368A/Y407V/Y349C:T366W/S354C), according to EU numbering.

In some embodiments, the first and/or the second Fc domains have an additional set of amino acid substitutions comprising Q295E/N384D/Q418E/N421D, according to EU numbering.

In some embodiments, the first and/or the second Fc domains have an additional set of amino acid substitutions consisting of G236R/L328R, E233P/L234V/L235A/G236_/ S239K, E233P/L234V/L235A/G236_/S239K/A327G, E233P/L234V/L235A/G236_/S267K/A327G, E233P/ L234V/L235A/G236_, and E233P/L234V/L235A/G236_/ S267K, according to EU numbering.

In some embodiments, the first second Fc domain and/or the second Fc domain comprise a further amino acid substitution selected from the group consisting of M428L, N434S, and M428L/N434S, according to EU numbering.

In some embodiments, the insert peptide comprises a domain linker engineered between helices D and E of an IL-10 monomer domain.

In some embodiments, the first IL-10 monomer domain and/or the second IL-10 monomer domain comprises a polypeptide sequence selected from the group consisting of SEQ ID NO:24 (IL10M1) as depicted in FIG. 15D and huIL10M1 variants as depicted in FIGS. 75A-75B.

In some embodiments, the first IL-10 monomer domain and/or the second IL-10 monomer domain comprises a variant IL-10 domain. In some embodiments, the variant IL-10 domain comprising one or more amino acid modifications selected from the group consisting of N21D, D28N, Q38E, M39T, D41N, Q42E, L43V, D44N, N45D, I87A, E142Q, D144N, E151Q, C12A, C108A, Q38E/D41N, Q38E/Q42E, Q38E/N45D, Q38E/E142Q, Q38E/D144N, D41N/Q42E, D41N/N45D, D41N/E142Q, D41N/D144N, Q42E/N45D, Q42E/E142Q, Q42E/D144N, N45D/E142Q, N45D/D144N, E142Q/D144N, N21D/Q42E, N21D/N45D, N21D/E151Q, N21D/N45E, Q42E/E151Q, N45D/E151Q, N21D/Q42E/N45D, N21D/Q42E/E151Q, Q42E/N45D/ E151Q, N21D/Q42E/N45E, N21D/Q42E/N45D/E151Q, F37C/M140C, Q38C/S141C, D41C/K138C, L47C/K138C, L48C/E142C, S51C/A120C, D55C/A120C, F56C/Y153C, C62A/C114A, A64C/S118C, M68C/V121C, V76C/A139C, L47Q, S118A, and A139Q.

In another aspect, the present invention provides a heterodimeric Fc fusion protein comprising: (a) a fusion protein comprising a first protein domain and a first Fc domain, wherein the first protein domain is covalently attached to the first Fc domain; and (b) a second Fc domain; wherein the first and the second Fc domains comprise modifications promoting heterodimerization of the first and the second Fc domains and wherein the first protein domain comprises an IL-10 monomer that comprises an insert peptide. The heterodimeric Fc fusion has an (IL10M1)1-heteroFc fusion format.

In some embodiments, the first protein domain (e.g., an IL-10 monomer that comprises an insert peptide) is attached to the N-terminus of the first Fc domain. In some embodiments, the first protein domain is attached to the C-terminus of the first Fc domain. In some embodiments, the first protein domain is attached to the first Fc domain using a domain linker.

In some embodiments, the modifications promoting heterodimerization of the first and the second Fc domains are a set of amino acid substitutions selected from the group consisting of L368D/K370S and S364K; L368D/K370S and S364K/E357L; L368D/K370S and S364K/E357Q; T411E/ K360E/Q362E and D401K; L368E/K370S and S364K; K370S and S364K/E357Q and T366S/L368A/Y407V: T366W (optionally including a bridging disulfide, T366S/ L368A/Y407V/Y349C:T366W/S354C), according to EU numbering.

In some embodiments, the first and/or the second Fc domains have an additional set of amino acid substitutions comprising Q295E/N384D/Q418E/N421D, according to EU numbering.

In some embodiments, the first and/or the second Fc domains have an additional set of amino acid substitutions consisting of G236R/L328R, E233P/L234V/L235A/G236_/ S239K, E233P/L234V/L235A/G236_/S239K/A327G, E233P/L234V/L235A/G236_/S267K/A327G, E233P/ L234V/L235A/G236_, and E233P/L234V/L235A/G236_/ S267K, according to EU numbering.

In some embodiments, the first Fc domain and/or second Fc domain comprise a further amino acid substitution selected from the group consisting of M428L, N434S, and M428L/N434S, according to EU numbering.

1 In some embodiments, the insert peptide comprises a domain linker engineered between helices D and E of an IL-10 monomer domain.

In some embodiments, the first IL-10 monomer domain and/or the second IL-10 monomer domain comprises a polypeptide sequence selected from the group consisting of SEQ ID NO:24 (IL10M1) as depicted in FIG. 15D and huIL10M1 variants as depicted in FIGS. 75A-75B.

In some embodiments, the first IL-10 monomer domain and/or the second IL-10 monomer domain comprises a variant IL-10 domain comprising one or more amino acid modifications selected from the group consisting of N21D, D28N, Q38E, M39T, D41N, Q42E, L43V, D44N, N45D, I87A, E142Q, D144N, E151Q, C12A, C108A, Q38E/D41N, Q38E/Q42E, Q38E/N45D, Q38E/E142Q, Q38E/D144N, D41N/Q42E, D41N/N45D, D41N/E142Q, D41N/D144N, Q42E/N45D, Q42E/E142Q, Q42E/D144N, N45D/E142Q, N45D/D144N, E142Q/D144N, N21D/Q42E, N21D/N45D, N21D/E151Q, N21D/N45E, Q42E/E151Q, N45D/E151Q, N21D/Q42E/N45D, N21D/Q42E/E151Q, Q42E/N45D/ E151Q, N21D/Q42E/N45E, N21D/Q42E/N45D/E151Q, F37C/M140C, Q38C/S141C, D41C/K138C, L47C/K138C, L48C/E142C, S51C/A120C, D55C/A120C, F56C/Y153C, C62A/C114A, A64C/S118C, M68C/V121C, V76C/A139C, L47Q, S118A, and A139Q.

In another aspect, the present invention provides a heterodimeric Fc fusion protein comprising: (a) a first fusion protein comprising a first protein domain and a first Fc domain, wherein the first protein domain is covalently attached to the first Fc domain; and (b) a second fusion protein comprising a second protein domain and a second Fc domain, wherein the second protein domain is covalently attached to the second Fc domain; wherein the first protein domain comprises helices A-D of an IL-10 monomer domain and the second protein domain comprises helices E-F of an IL-10 monomer domain. The heterodimeric Fc fusion protein has a (splitIL10)1-heteroFc format.

In some embodiments, the first protein domain is covalently attached to the N-terminus of the first Fc domain and/or the second protein domain is covalently attached to the N-terminus of the second Fc domain.

In some embodiments, the first protein domain is covalently attached to the C-terminus of the first Fc domain and/or the second protein domain is covalently attached to the C-terminus of the second Fc domain.

In some embodiments, the first protein domain is covalently attached to the first Fc domain via a first domain linker and/or the second protein domain is covalently attached to the second Fc domain via a second domain linker.

In some embodiments, the first Fc domain and/or the second Fc domain comprise a further amino acid substitution selected from the group consisting of M428L, N434S, and M428L/N434S, according to EU numbering.

In some embodiments, the first protein domain comprises a polypeptide sequence of SEQ ID NO:21 (hl-10(A-D)) as depicted in FIG. 15A or a polypeptide sequence having at least 90% (e.g., 90%, 91%, 92%, 93%, 94%, 95%, 96%, 97%, 98%, 99% or more) sequence identity to SEQ ID NO:21. In some embodiments, the second protein domain comprises a polypeptide sequence of SEQ ID NO:22 (hl-10(E-F)) as depicted in FIG. 15B or a polypeptide sequence having at least 90% (e.g., 90%, 91%, 92%, 93%, 94%, 95%, 96%, 97%, 98%, 99% or more) sequence identity to SEQ ID NO:22.

In some embodiments, the heterodimeric Fc fusion protein of the (splitIL10)1-heteroFc format comprises: (a) the first fusion protein having a polypeptide sequence of XENP25242 Chain 1 as depicted in FIG. 30, and (b) the second fusion protein having a polypeptide sequence of XENP25242 Chain 2 as depicted in FIG. 30.

In some embodiments, the heterodimeric Fc fusion protein of the (splitIL10)1-heteroFc format comprises: (a) the first fusion protein having a polypeptide sequence of XENP25243 Chain 1 as depicted in FIG. 30, and (b) the second fusion protein having a polypeptide sequence of XENP25243 Chain 2 as depicted in FIG. 30.

In some embodiments, the heterodimeric Fc fusion protein of the (splitIL10)1-heteroFc format comprises: (a) the first fusion protein having a polypeptide sequence of XENP25244 Chain 1 as depicted in FIG. 30, and (b) the second fusion protein having a polypeptide sequence of XENP25244 Chain 2 as depicted in FIG. 30.

Provided is a nucleic acid encoding any of the heterodimeric fusion protein described herein. Provided is a host cell comprising a nucleic acid encoding any of the heterodimeric fusion protein described herein.

In some embodiments, provided is a method of making a heterodimeric Fc fusion protein (e.g., a (splitIL10)1-heteroFc fusion protein) comprising culturing a host cell described under conditions whereby the heterodimeric Fc fusion protein is produced; and recovering the heterodimeric Fc fusion protein.

In another aspect, the present invention provides a heterodimeric Fc fusion protein comprising: (a) a first fusion protein comprising a first protein domain, a second protein domain, and a first Fc domain, wherein the first protein domain is covalently attached to the second protein domain, and the second protein domain is covalently attached to the first Fc domain; and (b) a second fusion protein comprising a third protein domain, a fourth protein domain, and a second Fc domain, wherein the third protein domain is covalently attached to the fourth protein domain, and the fourth protein domain is covalently attached to the second Fc domain; wherein the first protein domain and the second protein domain each comprises helices A-D of an IL-10 monomer domain, and wherein the third protein domain and the fourth protein domain each comprises helices E-F of an IL-10 monomer domain. The heterodimeric Fc fusion protein has a (splitIL10)2-heteroFc fusion format.

In some embodiments, the second protein is covalently attached to the N-terminus of the first Fc domain and/or the fourth protein domain is covalently attached to the N-terminus of the second Fc domain.

In some embodiments, the second protein is covalently attached to the C-terminus of the first Fc domain and/or the fourth protein domain is covalently attached to the C-terminus of the second Fc domain.

In some embodiments, the first protein domain is covalently attached to the second protein domain via a first domain linker and/or the third protein domain is covalently attached to the third protein domain via a second domain linker.

In some embodiments, the second protein domain is covalently attached to the first Fc domain via a third domain linker and/or the fourth protein domain is covalently attached to the second Fc domain via a fourth domain linker.

1 In some embodiments, the first and/or second Fc domains comprise a further amino acid substitution selected from the group consisting of M428L, N434S, and M428L/N434S, according to EU numbering. In one embodiment, the first Fc domain comprises a further amino acid substitution selected from the group consisting of M428L, N434S, and M428L/N434S. In one embodiment, the second Fc domain comprises a further amino acid substitution selected from the group consisting of M428L, N434S, and M428L/N434S. In some embodiments, the first and second Fc domains each comprise a further amino acid substitution selected from the group consisting of M428L, N434S, and M428L/N434S.

In some embodiments, the first protein domain and/or the second protein domain comprises a polypeptide sequence of SEQ ID NO:21 (hIL-10(A-D)) as depicted in FIG. 15A or a polypeptide sequence having at least 90% (e.g., 90%, 91%, 92%, 93%, 94%, 95%, 96%, 97%, 98%, 99% or more) sequence identity to SEQ ID NO:21. In some embodiments, the third protein domain and/or the fourth protein domain comprises a polypeptide sequence of SEQ ID NO:22 (hIL-10(E-F)) as depicted in FIG. 15B or a polypeptide sequence having at least 90% (e.g., 90%, 91%, 92%, 93%, 94%, 95%, 96%, 97%, 98%, 99% or more) sequence identity to SEQ ID NO:22.

Provided is a nucleic acid encoding any of the heterodimeric fusion protein (e.g., (splitIL10)2-heteroFc fusion) described herein. Provided is a host cell comprising a nucleic acid encoding any of the heterodimeric fusion protein described herein.

In some embodiments, provided is a method of making a heterodimeric Fc fusion protein (e.g., a (splitIL10)2-heteroFc fusion protein) comprising culturing a host cell described under conditions whereby the heterodimeric Fc fusion protein is produced; and recovering the heterodimeric Fc fusion protein.

In another aspect, the present invention provides a heterodimeric Fc fusion protein comprising: (a) a first fusion protein comprising an antigen binding domain (ABD) and a first Fc domain, wherein the antigen binding domain is covalently attached to the N-terminus of the first Fc domain; and (b) a second fusion protein comprising a protein domain and a second Fc domain, wherein the protein domain is covalently attached to the N-terminus of the second Fc domain, and wherein the protein domain comprises a first IL-10 monomer domain. The heterodimeric Fc fusion protein has an anti-XxIL10-heteroFc fusion format.

In some embodiments, the heterodimeric Fc fusion protein further comprises a second IL-10 monomer domain non-covalently attached to the first IL-10 monomer domain.

In some embodiments, the antigen binding domain is attached to the first Fc domain using a first domain linker. In some embodiments, the first IL-10 monomer domain is attached to the second Fc domain using a second domain linker.

In some embodiments, the modifications promoting heterodimerization of the first and the second Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q and T366S/L368A/Y407V: T366W (optionally including a bridging disulfide, T366S/L368A/Y407V/Y349C:T366W/S354C), according to EU numbering.

In some embodiments, the first and/or the second Fc domains have an additional set of amino acid substitutions comprising Q295E/N384D/Q418E/N421D, according to EU numbering.

In some embodiments, the first and/or the second Fc domains have an additional set of amino acid substitutions consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

In some embodiments, the first Fc domain and/or the second Fc domain comprise a further amino acid substitution selected from the group consisting of M428L, N434S, and M428L/N434S, according to EU numbering.

In some embodiments, the first and/or the second IL-10 monomer domain comprises a polypeptide sequence selected from the group consisting of SEQ ID NO:1 (human IL-10 (109H) precursor sequence), SEQ ID NO:2 (human IL-10 (109L) precursor sequence), SEQ ID NO:3 (human IL-10 (109H) mature form sequence), SEQ ID NO:4 (human IL-10 (109L) mature form sequence), as depicted in FIG. 1.

In some embodiments, the first IL-10 monomer domain and/or the second IL-10 monomer domain is a variant IL-10 monomer domain.

In some embodiments, the variant IL-10 monomer domain comprises an IL-10 monomer domain with one or more amino acid substitutions resulting in altered affinity for an IL-10 receptor, altered potency, altered potential for deamidation, altered potential for aspartic acid isomerization, altered potential for degradation-related PTMs, altered potential degradation sites, altered disulfide bridges, and/or altered potential N-glycosylation sites. In some embodiments, the variant IL-10 monomer domain comprises one or more amino acid modifications at amino acid residues selected from the group consisting of N21, D28, Q38, M39, D41, Q42, L43, D44, N45, I87, E142, D144, E151, and N160. In some embodiments, the variant IL-10 monomer domain comprises one or more amino acid modifications selected from the group consisting of N21D, D28N, Q38E, M39T, D41N, Q42E, L43V, D44N, N45D, I87A, E142Q, D144N, E151Q, and N160del.

In some embodiments, the antigen binding domain (ABD) is selected from the group consisting of a PD-1 binding domain, a non-competing PD-1 binding domain, a TIGIT binding domain, a CD8 binding domain, and a NKG2D binding domain.

In some embodiments, the PD-1 binding domain is a humanized PD-1 ABD. In some embodiments, the humanized PD-1 ABD comprises a variable heavy chain and variable light chain pair selected from a group consisting of: 1C11[PD-1]_H0L0, 1C11[P, D-1]_H3L3, 1C11[PD-1]_H3.240_L3.148, 1C11[PD-1]_H3.241_L3.148, 1C11[PD-1]_H3.234_L3.144, 1C11[PD-1]_H3.241_L3.92, 1C11[PD-1]_H3.303_L3.152, 1C11_H3.329_L3.220, 1C11_H3.328_L3.152, pembrolizumab variable heavy chain and variable light chain, nivolumab variable heavy chain and variable light chain, pidilizumab variable heavy chain and variable light chain, MK-3475 variable heavy chain and variable light chain, BAP049 Clone E variable heavy chain and variable light chain, BAP049 Clone B variable heavy chain and variable light chain, H7798N[PD-1] variable heavy chain and variable light chain, h1H3 Var 6[PD-1] variable heavy chain and variable light chain, APE2058[PD-1] variable heavy chain and variable light chain, H005-1[PD-1] variable heavy chain and variable light chain, 317-4B6[PD-1] variable heavy chain and variable light chain, 326-4A3[PD-1] variable heavy chain and variable light chain, hPD-1 mAb 7 (1.2)[PD-1] variable heavy chain and variable light chain, Clone 38[PD-1] variable heavy chain and variable light chain, Clone 39[PD-1] variable heavy chain and variable light chain, Clone 41[PD-1] variable heavy chain and variable light chain, Clone 48[PD-1] variable heavy chain and variable light chain, PD1-17[PD-1] variable heavy chain and variable light chain, PD1-28[PD-1] variable heavy chain and variable light chain, PD1-33[PD-1] variable heavy chain and variable light chain, PD1-35[PD-1] variable heavy chain and variable light chain, LOPD180 variable heavy chain and variable light chain, Ab948 variable heavy chain and variable light chain, humanized EH-12.2H7[PD-1] variable heavy chain and variable light chain, RG1H10 variable heavy chain and variable light chain, RG1H10-H2A-22-1S variable heavy chain and variable light chain, RG1H10-H2A-27-2S variable heavy chain and variable light chain, RG1H10-3C variable heavy chain and variable light chain, RG1H10-16C variable heavy chain and variable light chain, RG1H10-17C variable heavy chain and variable light chain, RG1H10-19C variable heavy chain and variable light chain, RG1H10-21C variable heavy chain and variable light chain, RG1H10-23C2 variable heavy chain and variable light chain, mAb7[PD-1], and PD1AB-6[PD-1] variable heavy chain and variable light chain, as depicted in FIGS. 100A-100G.

In some embodiments, the non-competing PD-1 binding domain is a humanized non-competing PD1 ABD that does not bind the same epitope as nivolumab and/or pembrolizumab. In some embodiments, the humanized non-competing PD-1 ABD comprises a variable heavy chain and variable light chain pair selected from a group consisting of: mAb A[PD-1]_H1_L1, mAb B[PD-1]_H1_L1, mAb C[PD-1]_H1_L1, mAb C[PD-1]_H1_L1.1, mAb C[PD-1]_H1_L1.3, mAb C[PD-1]_H1_L1.45, mAb C[PD-1]_H1_L1.117, mAb C[PD-1]_H1_L1.129, mAb C[PD-1]_H1_L1.135, mAb C[PD-1]_H1_L1.136, mAb C[PD-1]_H1_L1.140, mAb C[PD-1]_H1_L2, mAb C[PD-1]_H1.19_11, mAb C[PD-1]_H1.19_L1.1, mAb C[PD-1]_H1.19_L1.3, mAb C[PD-1]_H1.19_L1.45, mAb C[PD-1]_H1.19_L1.117, mAb C[PD-1]_H1.19_L1.129, mAb C[PD-1]_H1.19_L1.135, mAb C[PD-1]_H1.19_L1.136, mAb C[PD-1]_H1.19_L1.140, mAb C[PD-1]_H1.19_L2, mAb C[PD-1]_H1.48_11, mAb C[PD-1]_H1.48_L1.1, mAb C[PD-1]_H1.48_L1.3, mAb C[PD-1]_H1.48_L1.45, mAb C[PD-1]_H1.48_L1.117, mAb C[PD-1]_H1.48_L1.129, mAb C[PD-1]_H1.48_L1.135, mAb C[PD-1]_H1.48_L1.136, mAb C[PD-1]_H1.48_L1.140, mAb C[PD-1]_H1.48_L2, mAb C[PD-1]_H1.125_11, mAb C[PD-1]_H1.125_L1.1, mAb C[PD-1]_H1.125_L1.3, mAb C[PD-1]_H1.125_L1.45, mAb C[PD-1]_H1.125_L1.117, mAb C[PD-1]_H1.125_L1.129, mAb C[PD-1]_H1.125_L1.135, mAb C[PD-1]_H1.125_L1.136, mAb C[PD-1]_H1.125_L1.140, mAb C[PD-1]_H1.125_L2, mAb C[PD-1]_H1.130_11, mAb C[PD-1]_H1.130_L1.1, mAb C[PD-1]_H1.130_L1.3, mAb C[PD-1]_H1.130_L1.45, mAb C[PD-1]_H1.130_L1.117, mAb C[PD-1]_H1.130_L1.129, mAb C[PD-1]_H1.130_L1.135, mAb C[PD-1]_H1.130_L1.136, mAb C[PD-1]_H1.130_L1.140, mAb C[PD-1]_H1.130_L2, mAb C[PD-1]_H1.132_11, mAb C[PD-1]_H1.132_L1.1, mAb C[PD-1]_H1.132_L1.3, mAb C[PD-1]_H1.132_L1.45, mAb C[PD-1]_H1.132_L1.117, mAb C[PD-1]_H1.132_L1.129, mAb C[PD-1]_H1.132_L1.135, mAb C[PD-1]_H1.132_L1.136, mAb C[PD-1]_H1.132_L1.140, mAb C[PD-1]_H1.132_L2, mAb C[PD-1]_H1.169_11, mAb C[PD-1]_H1.169_L1.1, mAb C[PD-1]_H1.169_L1.3, mAb C[PD-1]_H1.169_L1.45, mAb C[PD-1]_H1.169_L1.117, mAb C[PD-1]_H1.169_L1.129, mAb C[PD-1]_H1.169_L1.135, mAb C[PD-1]_H1.169_L1.136, mAb C[PD-1]_H1.169_L1.140, mAb C[PD-1]_H1.169_L2, mAb C[PD-1]_H1.175_11, mAb C[PD-1]_H1.175_L1.1, mAb C[PD-1]_H1.175_L1.3, mAb C[PD-1]_H1.175_L1.45, mAb C[PD-1]_H1.175_L1.117, mAb C[PD-1]_H1.175_L1.129, mAb C[PD-1]_H1.175_L1.135, mAb C[PD-1]_H1.175_L1.136, mAb C[PD-1]_H1.175_L1.140, mAb C[PD-1]_H1.175_L2, mAb C[PD-1]_H2_L1, mAb C[PD-1]_H2_L1.1, mAb C[PD-1]_H2_L1.3, mAb C[PD-1]_H2_L1.45, mAb C[PD-1]_H2_L1.117, mAb C[PD-1]_H2_L1.129, mAb C[PD-1]_H2_L1.135, mAb C[PD-1]_H2_L1.136, mAb C[PD-1]_H2_L1.140, and mAb C[PD-1]_H2_L2, as depicted in FIGS. 104A-104B.

In some embodiments, the CD8 binding domain is a humanized CD8 ABD. In some embodiments, the humanized CD8 ABD comprises a variable heavy chain and variable light chain pair selected from a group consisting OKT8_H2L1 and 1C11B3_H1L1, as depicted in FIG. 92.

In some embodiments, the NKG2D binding domain is a humanized NKG2D ABD. In some embodiments, the humanized NKG2D ABD comprises a variable heavy chain and variable light chain pair selected from a group consisting MS[NKG2D] H0_L0, 1D7B4[NKG2D]_H1_L1, KYK-1.0[NKG2D]_H1_L1, KYK-2.0[NKG2D]_H0_L0, 11B2D10[NKG2D]_H0_L0, 6E5A7[NKG2D]_H0_L0, 6H7E7[NKG2D]_H0_L0, mAb E[NKG2D]_H1_L1, 16F31[NKG2D]_H1_L1, mAb D[NKG2D]_H1_L1, 1 D7B4[NKG2D]_H1_L1, mAb A[NKG2D]_H1_L1, mAb A[NKG2D]_H2_L1, mAb A[NKG2D]_H1_L2, mAb A[NKG2D]_H2_L2, mAb B[NKG2D]_H1_L1, mAb B[NKG2D]_H1_L1.1, mAb B[NKG2D]_H1_L2, mAb B[NKG2D]_H2_L1, mAb B[NKG2D]_H2_L1.1, mAb B[NKG2D]_H2_L2, mAb B[NKG2D]_H3_L1, mAb B[NKG2D]_H3_L1.1, mAb B[NKG2D]_H3_L2, mAb C[NKG2D]_H1_L1, mAb C[NKG2D]_H2_L1, mAb C[NKG2D]_H1_L2, and mAb C[NKG2D]_H2_L2, as depicted in FIGS. 93A-93C.

Provided is a nucleic acid encoding any of the heterodimeric fusion protein described herein of the anti-XxIL-10-heteroFc fusion format. Provided is a host cell comprising a nucleic acid encoding any of the heterodimeric fusion protein described herein.

In some embodiments, provided is a method of making a heterodimeric Fc fusion protein (e.g., an anti-XxIL-10-heteroFc fusion protein) comprising culturing a host cell described under conditions whereby the heterodimeric Fc fusion protein is produced; and recovering the heterodimeric Fc fusion protein.

In some embodiments, provided herein is a method of purifying a heterodimeric Fc fusion protein described herein of the anti-X×IL-10-heteroFc fusion format. The method comprises: (a) providing a composition comprising the heterodimeric Fc fusion protein; (b) loading the composition onto an ion exchange column; and (c) collecting a fraction containing the heterodimeric Fc fusion protein.

BRIEF DESCRIPTION OF THE DRAWINGS

FIG. 1 depicts the sequences for human IL-10 (both the IL-10(109H) and IL-10(109L) sequences) and its receptors.

FIG. 2 depicts the sequences for mouse IL-10 and its receptors to facilitate investigation of IL-10 fusion proteins of the invention in preclinical studies.

FIG. 3 depicts the sequences for cynomolgus IL-10 and its receptors to facilitate investigation of IL-10 fusion proteins of the invention in preclinical studies.

FIG. 4 depicts the sequences for viral IL-10 homolog.

FIG. 5A-5E depict useful pairs of Fc heterodimerization variant sets (including skew and pI variants). Variants without a corresponding "monomer 2" are pI variants which can be used alone on either monomer.

FIG. 6 depict a list of isosteric variant antibody constant regions and their respective substitutions. pI_(−) indicates lower pI variants, while pI_(+) indicates higher pI variants. These can be optionally and independently combined with other heterodimerization variants of the inventions (and other variant types as well, as outlined herein.)

FIG. 7 depict useful ablation variants that ablate FcγR binding (sometimes referred to as "knock outs" or "KO" variants). Generally, ablation variants are found on both monomers, although in some cases they may be on only one monomer.

FIG. 8 shows a particularly useful embodiment of "non-cytokine" components of the IL-10 fusions of the invention.

FIG. 9 shows particularly useful embodiments of "non-cytokine"/"non-Fv" components of the invention.

FIG. 10 shows the sequences of several useful homodimeric IL-10 fusion backbones based on human IgG1, without the cytokine sequences. Homodimeric Fc backbone 1 is based on human IgG1 (356E/358M allotype), and includes the E233P/L234V/L235A/G236del/S267K ablation variants and C220S. Homodimeric Fc backbone 2 is based on human IGG1 (356D/358L allotype), and includes the E233P/L234V/L235A/G236del/S267K ablation variants and C220S. Homodimeric Fc backbone 3 is based on human IgG4, and the S228P (according to EU numbering; S241P in Kabat) variant that ablates Fab arm exchange (as is known in the art). Homodimeric Fc backbone 4 is based on human IgG2, and includes the S267K ablation variant. Alternative formats for homodimeric backbone 4 can include C219S and/or C220S. These sequences can be used with any of the IL-10 fusions of the inventions utilizing a homodimeric Fc region. These sequences can also be used with formats of the targeted IL-10 fusions of the invention utilizing a homodimeric Fc region. In targeted IL-10 fusion formats which include a variable heavy domain covalently linked to the Fc, the variable heavy domain may be covalently linked to the Fc domain by a corresponding CH1 domain and partial hinge region, illustrative sequences for which are depicted in FIG. 12, and may exclude the C220S and/or C219S substitutions.

FIG. 11A-11C show the sequences of several useful heterodimeric IL-10 fusion backbones based on human IgG1, without the cytokine sequences. While these backbones find use in the IL-10 fusions of the invention, they also find use in formats of the targeted IL-10 fusions of the invention. Heterodimeric Fc backbone 1 is based on human IgG1 (356E/358M allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants and C220S on both chains. Heterodimeric Fc backbone 2 is based on human IgG1 (356E/358M allotype), and includes the L368D/K370S skew variants and the Q295E/N384D/Q418E/N421D pI variants on a first heterodimeric Fc chain, the S364K skew variant on a second heterodimeric Fc chain, and the E233P/L234V/L235A/G236del/S267K ablation variants and C220S on both chains. Heterodimeric Fc backbone 3 is based on human IgG1 (356E/358M allotype), and includes the L368E/K370S skew variants and the Q295E/N384D/Q418E/N421D pI variants on a first heterodimeric Fc chain, the S364K skew variant on a second heterodimeric Fc chain, and the E233P/L234V/L235A/G236del/S267K ablation variants and C220S on both chains. Heterodimeric Fc backbone 4 is based on human IgG1 (356E/358M allotype), and includes the K360E/Q362E/T411E skew variants and the Q295E/N384D/Q418E/N421D pI variants on a first heterodimeric Fc chain, the D401K skew variant on a second heterodimeric Fc chain, and the E233P/L234V/L235A/G236del/S267K ablation variants and C220S on both chains. Heterodimeric Fc backbone 5 is based on human IgG1 (356D/358L allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants and C220S on both chains. Heterodimeric Fc backbone 6 is based on human IgG1 (356E/358M allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants, N297A variant that removes glycosylation, and C220S on both chains. Heterodimeric Fc backbone 7 is based on human IgG1 (356E/358M allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants, N297S variant that removes glycosylation, and C220S on both chains. Heterodimeric Fc backbone 8 is based on human IgG4, and includes the L368D/K370S skew variants and the Q295E/N384D/Q418E/N421D pI variants on a first heterodimeric Fc chain, the S364K/E357Q skew variants on a second heterodimeric Fc chain, and the S228P (according to EU numbering, S241P in Kabat) variant that ablates Fab arm exchange (as is known in the art) on both chains. Heterodimeric Fc backbone 9 is based on human IgG2, and includes the L368D/K370S skew variants and the Q295E/N384D/Q418E/N421D pI variants on a first heterodimeric Fc chain, the S364K/E357Q skew variants on a second heterodimeric Fc chain. Heterodimeric Fc backbone 10 is based on human IgG2, and includes the L368D/K370S skew variants and the Q295E/N384D/Q418E/N421D pI variants on a first heterodimeric Fc chain, the S364K/E357Q skew variants on a second heterodimeric Fc chain, and the S267K ablation variant on both chains. Alternative formats for heterodimeric Fc backbones 9 and 10 can include C220S and/or C219S (in the case of a backbone based on IgG2). Heterodimeric Fc backbone 11 is based on human IgG1 (356E/358M allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants, M428L/N434S Xtend variants, and C220S on both chains. Heterodimeric Fc backbone 12 is based on human IgG1 (356E/358M allotype), and includes the L368D/K370S skew variants on a first heterodimeric Fc chain, the S364K/E357Q skew variants and P217R/P229R/N276K pI variants on a second heterodimeric Fc chain, and the E233P/L234V/L235A/G236del/S267K ablation variants and C220S on both chains.

Figures 32A, 32B, 32C:
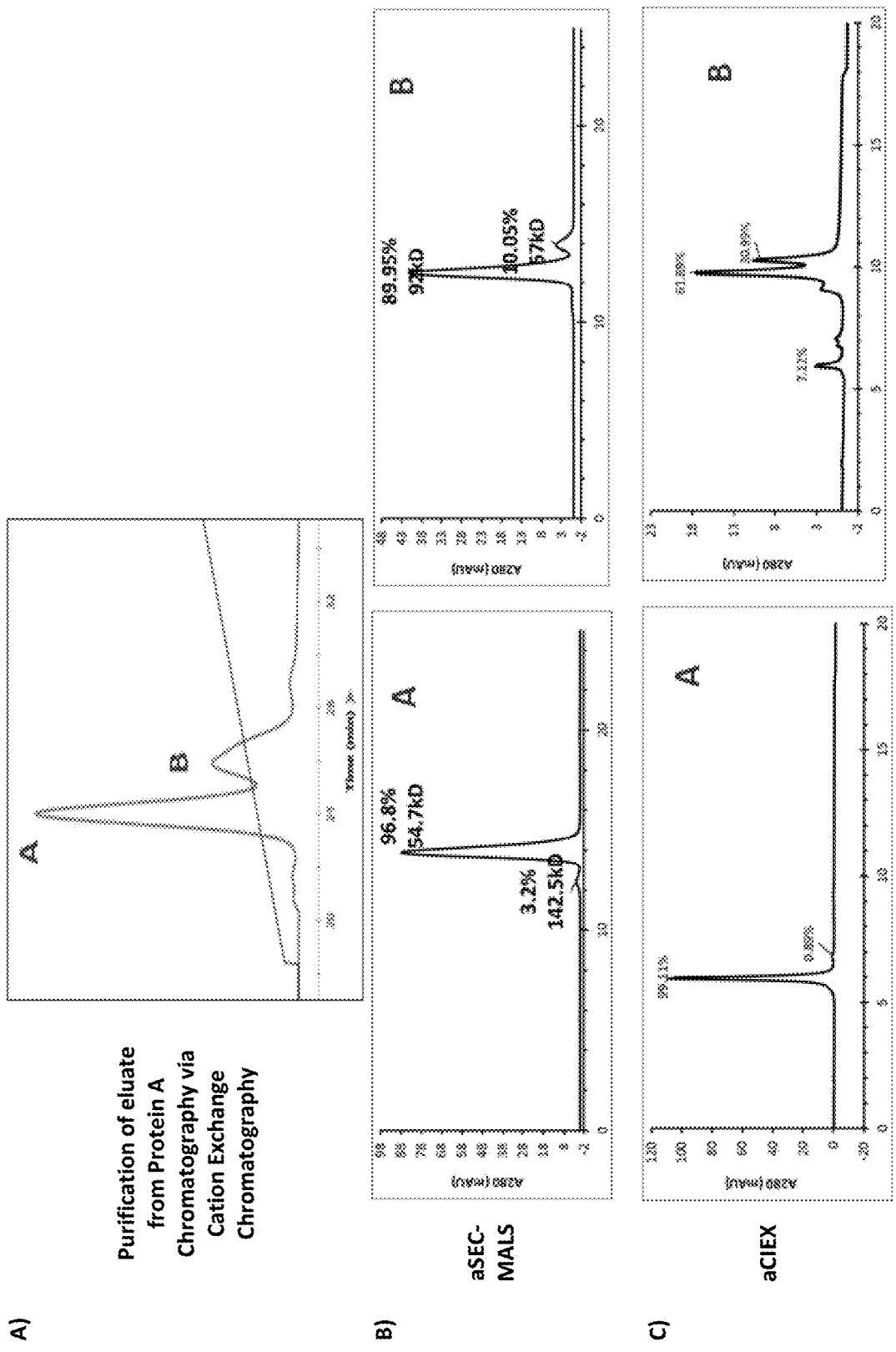
Figure 33A:
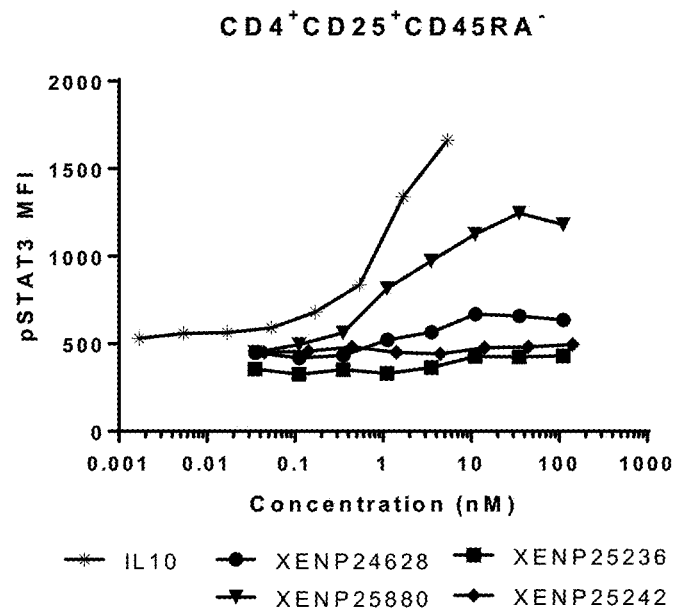
Figure 33B:
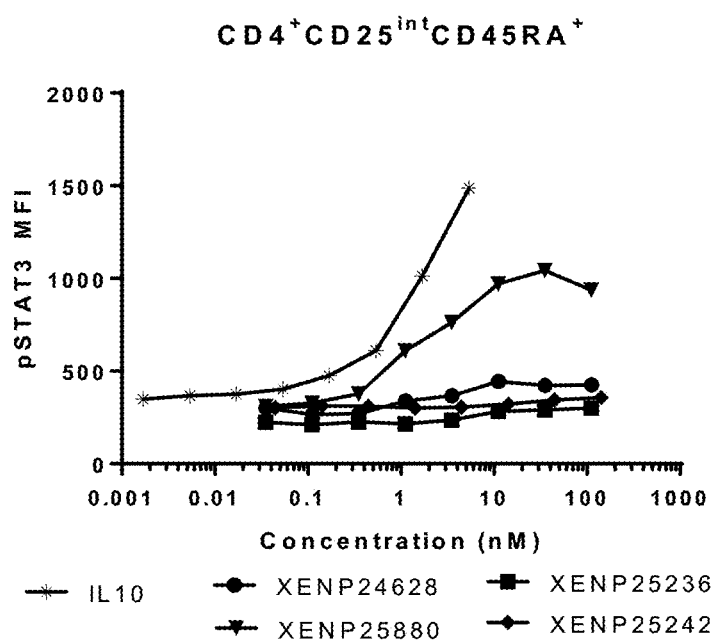
Figure 33C:
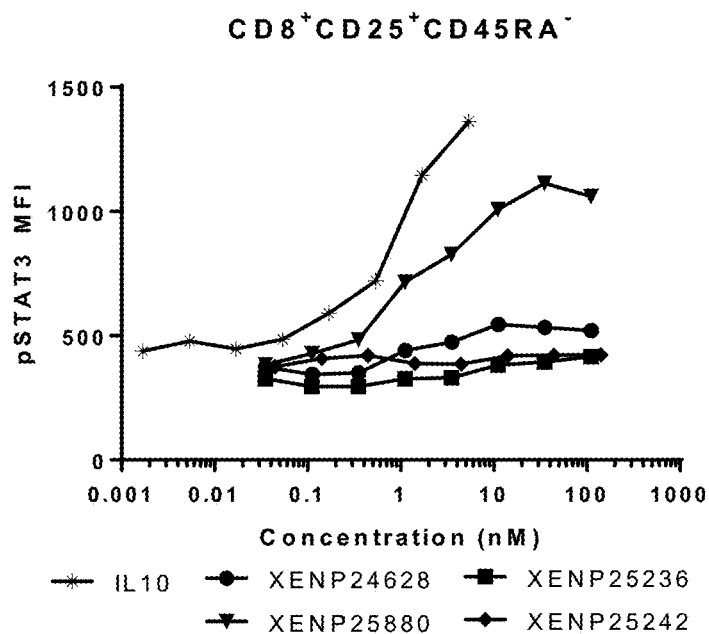
Figure 33D:
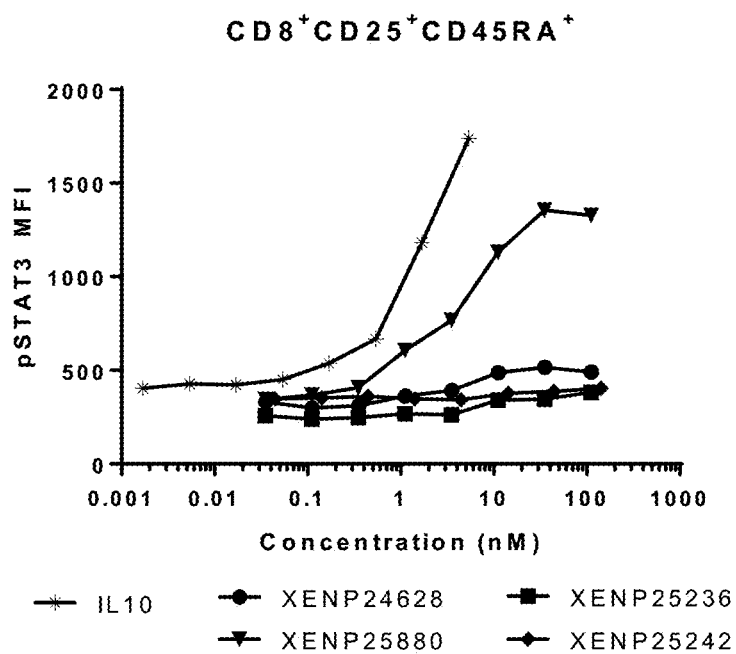
Figure 33E:
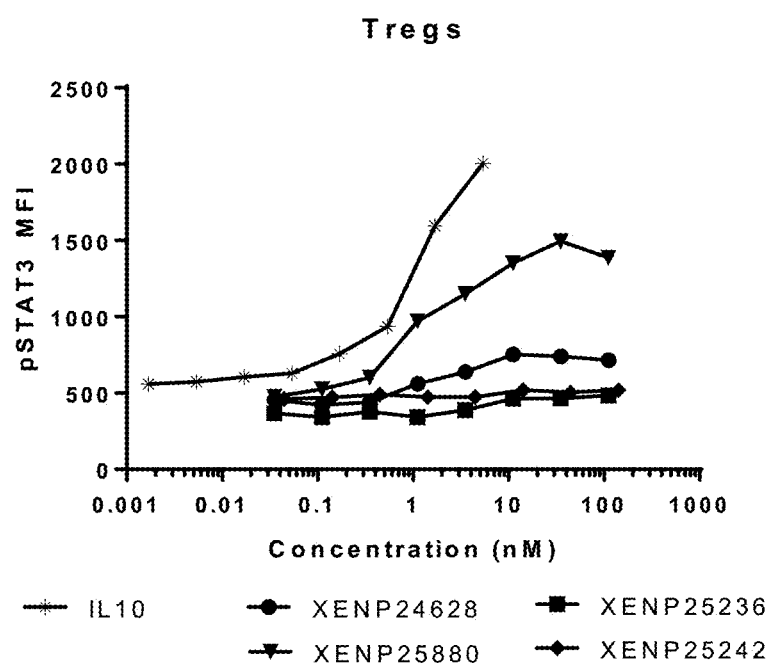
Figure 34A:
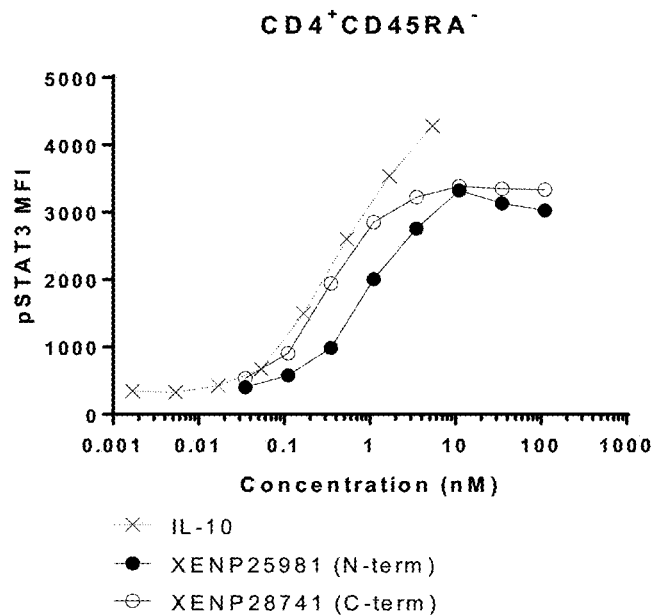
Figure 34B:
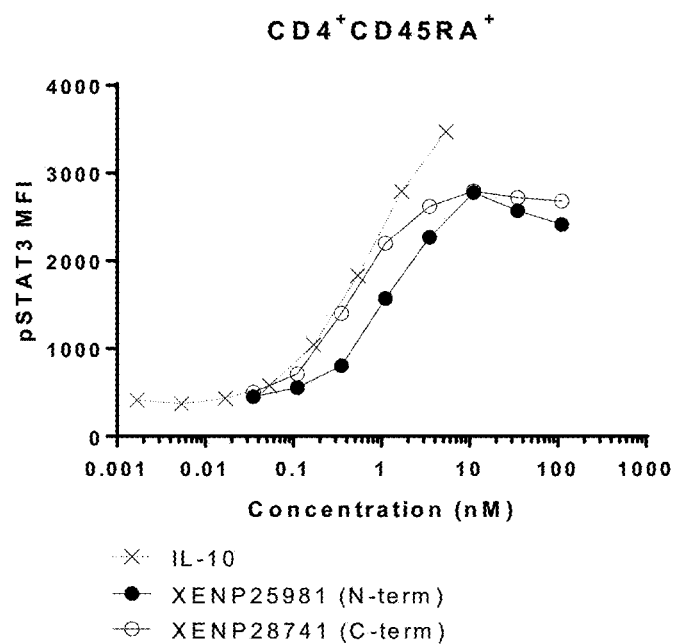
Figure 34C:
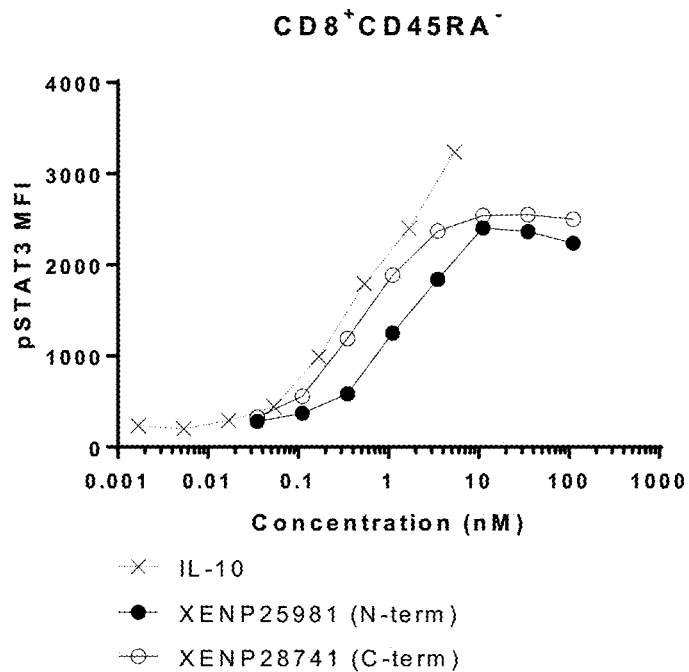
Figure 34D:
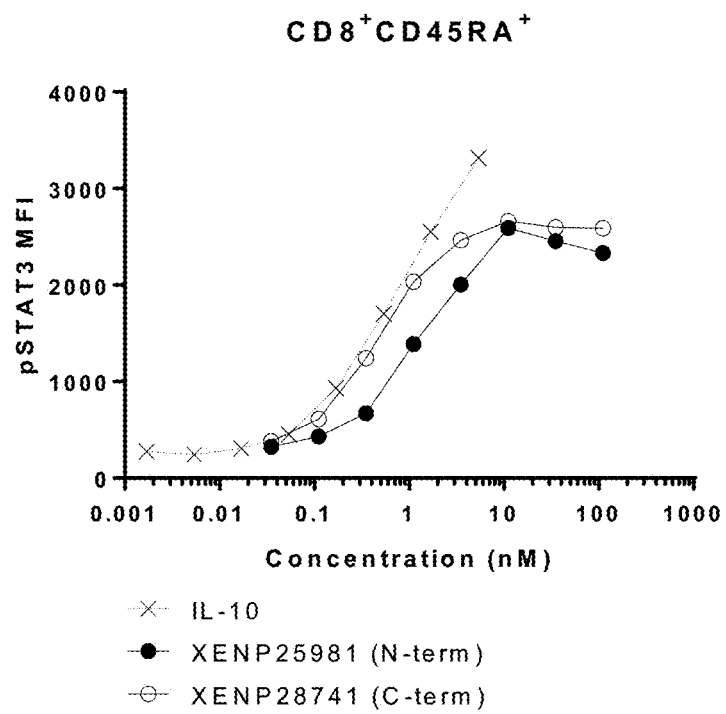
Figure 34E:
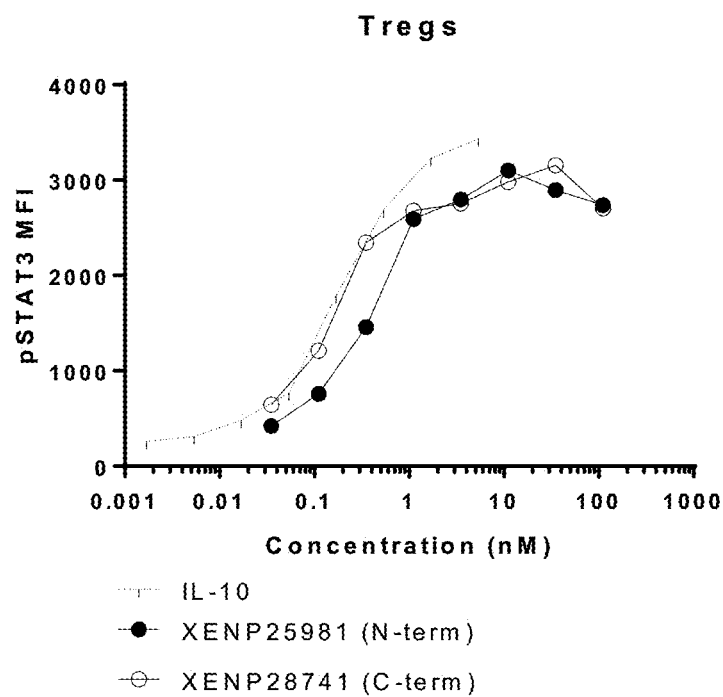
Figure 42A:
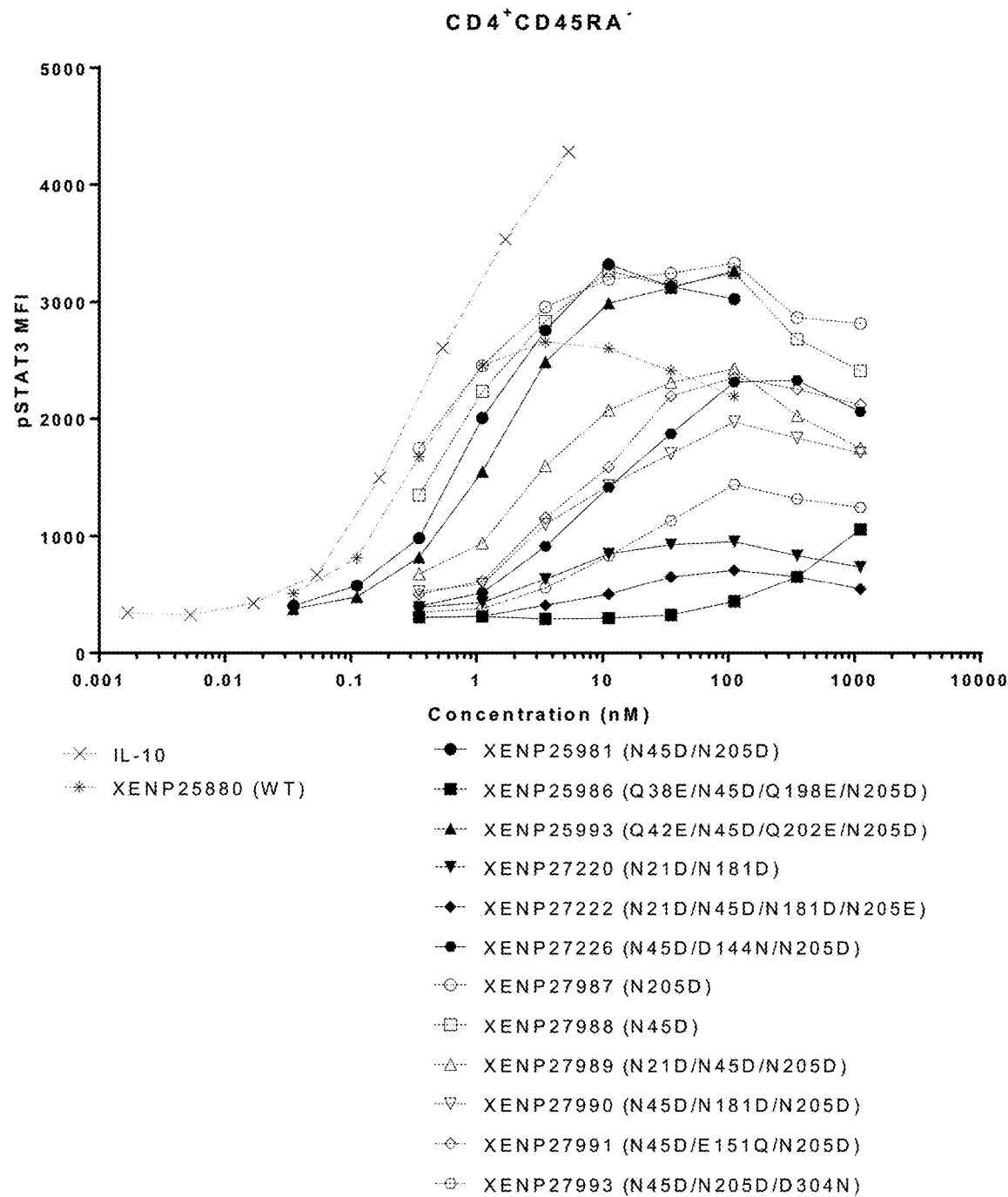
Figure 42B:
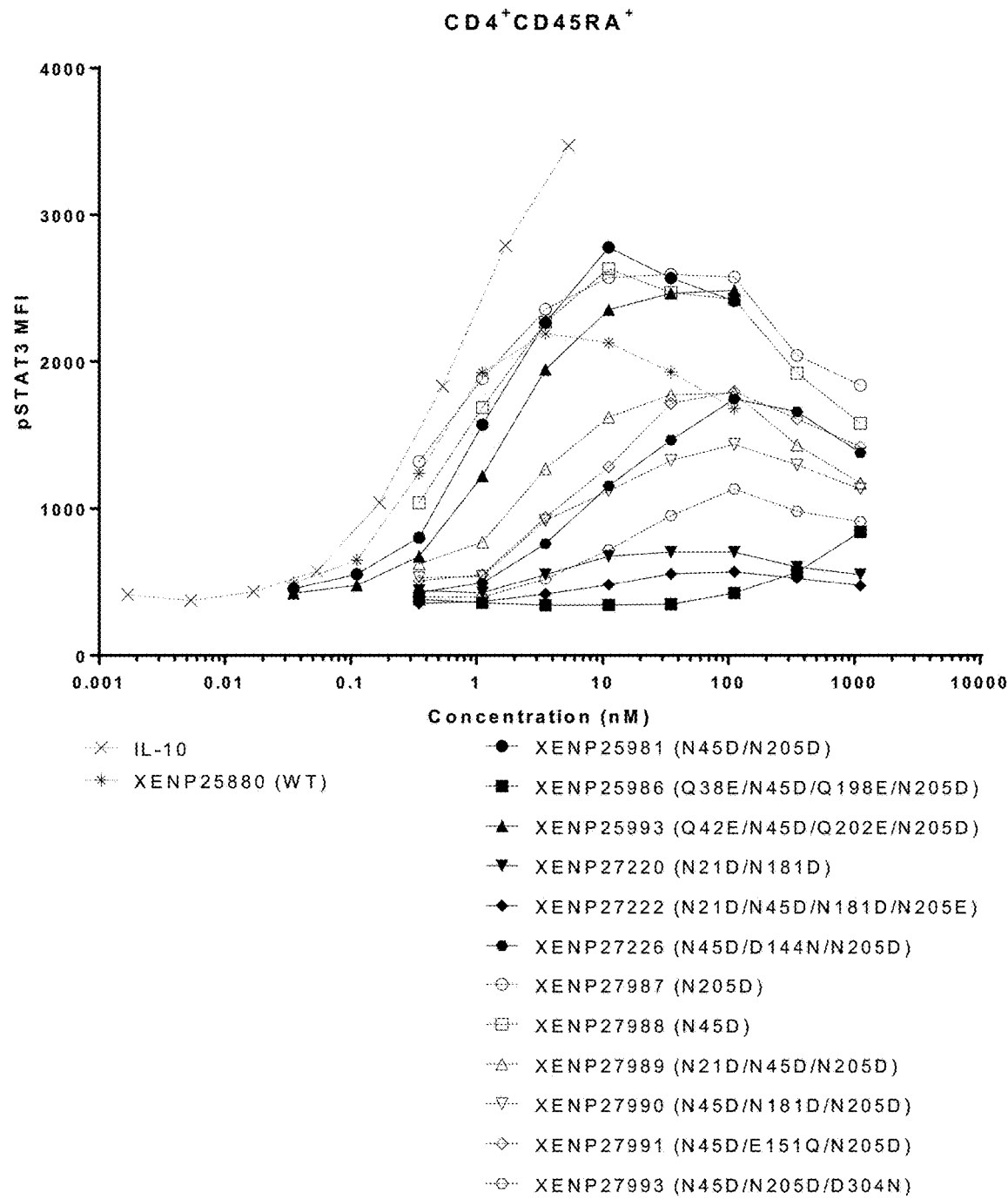
Figure 42C:
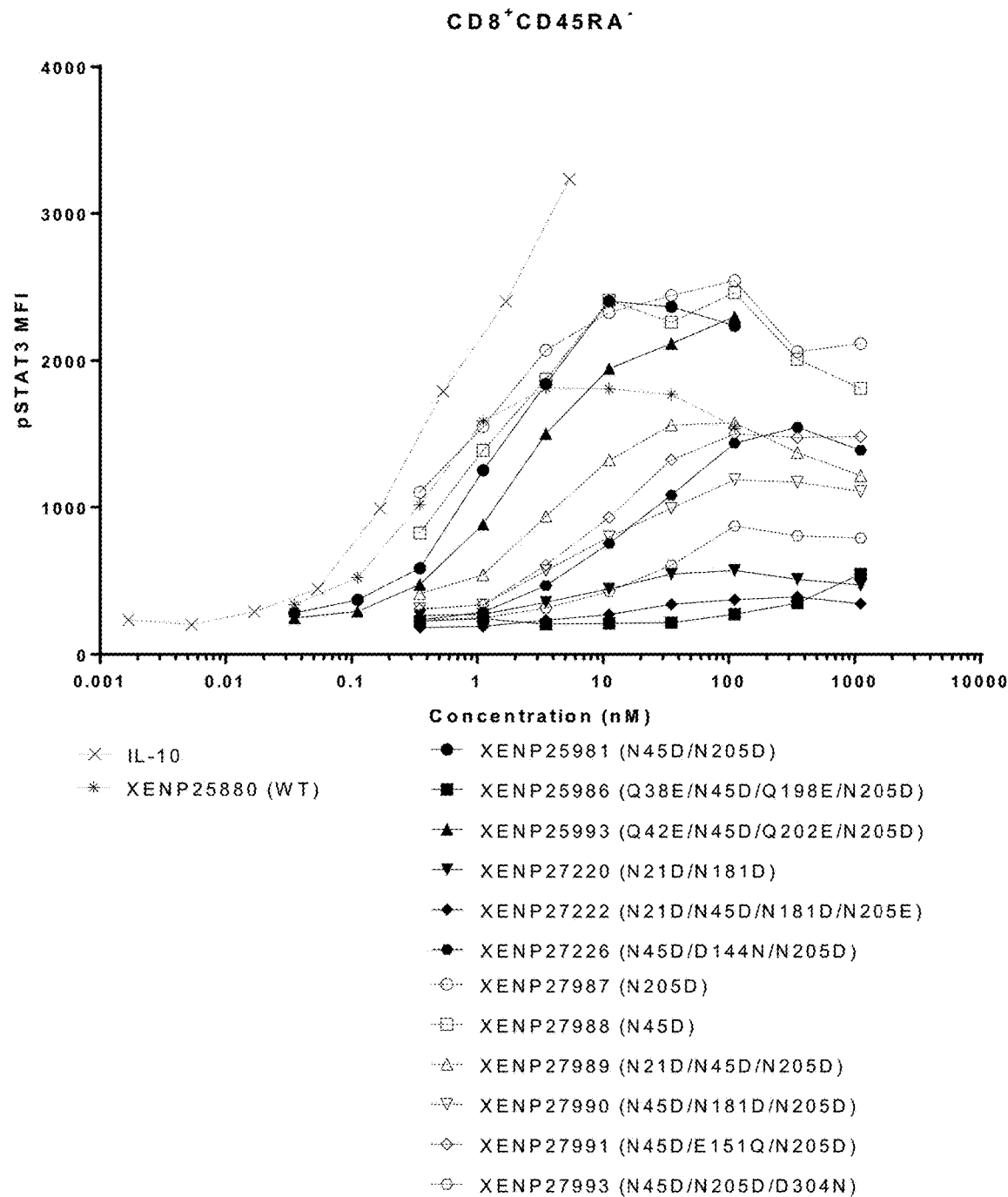
Figure 42D:
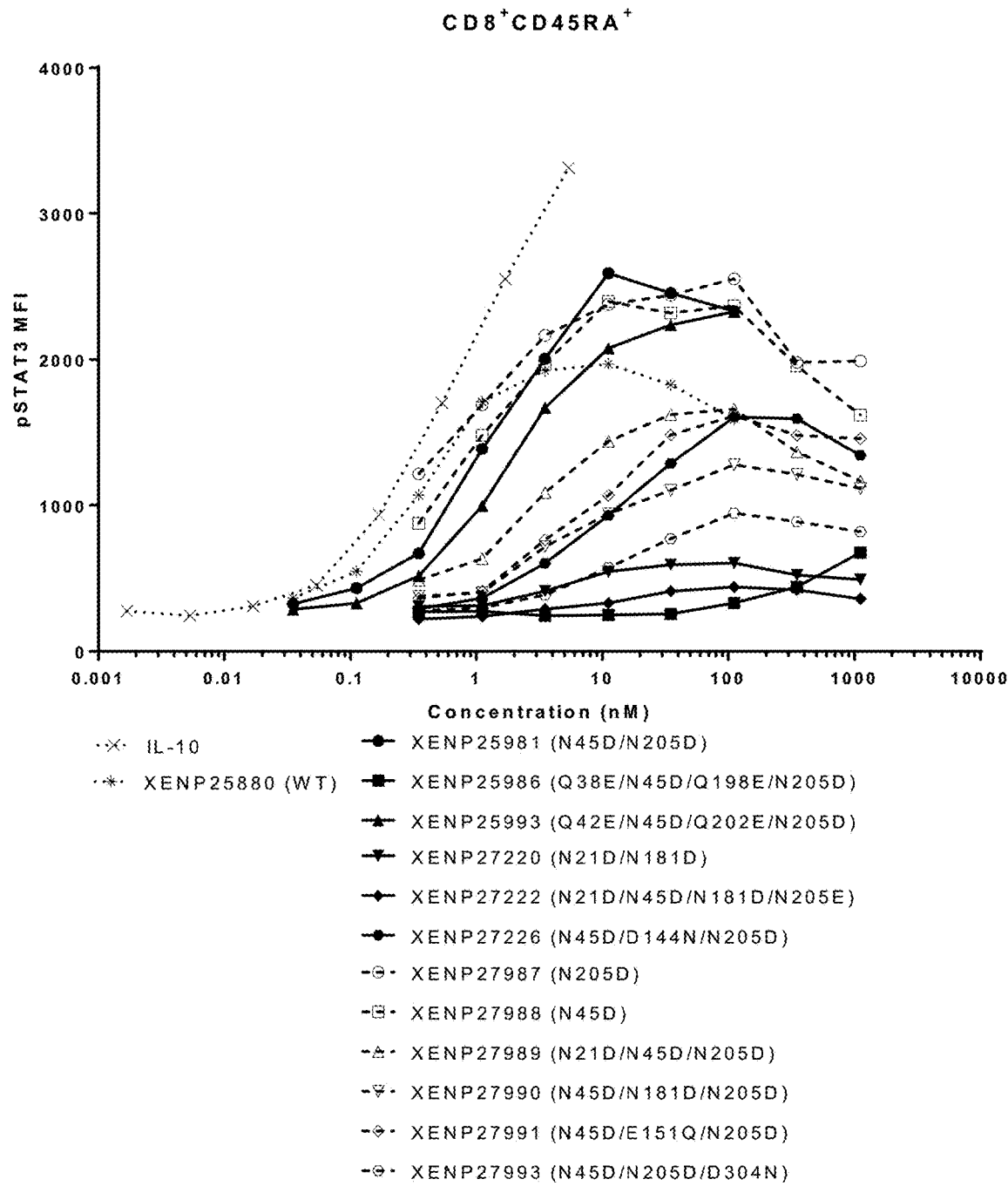
Figure 42E:
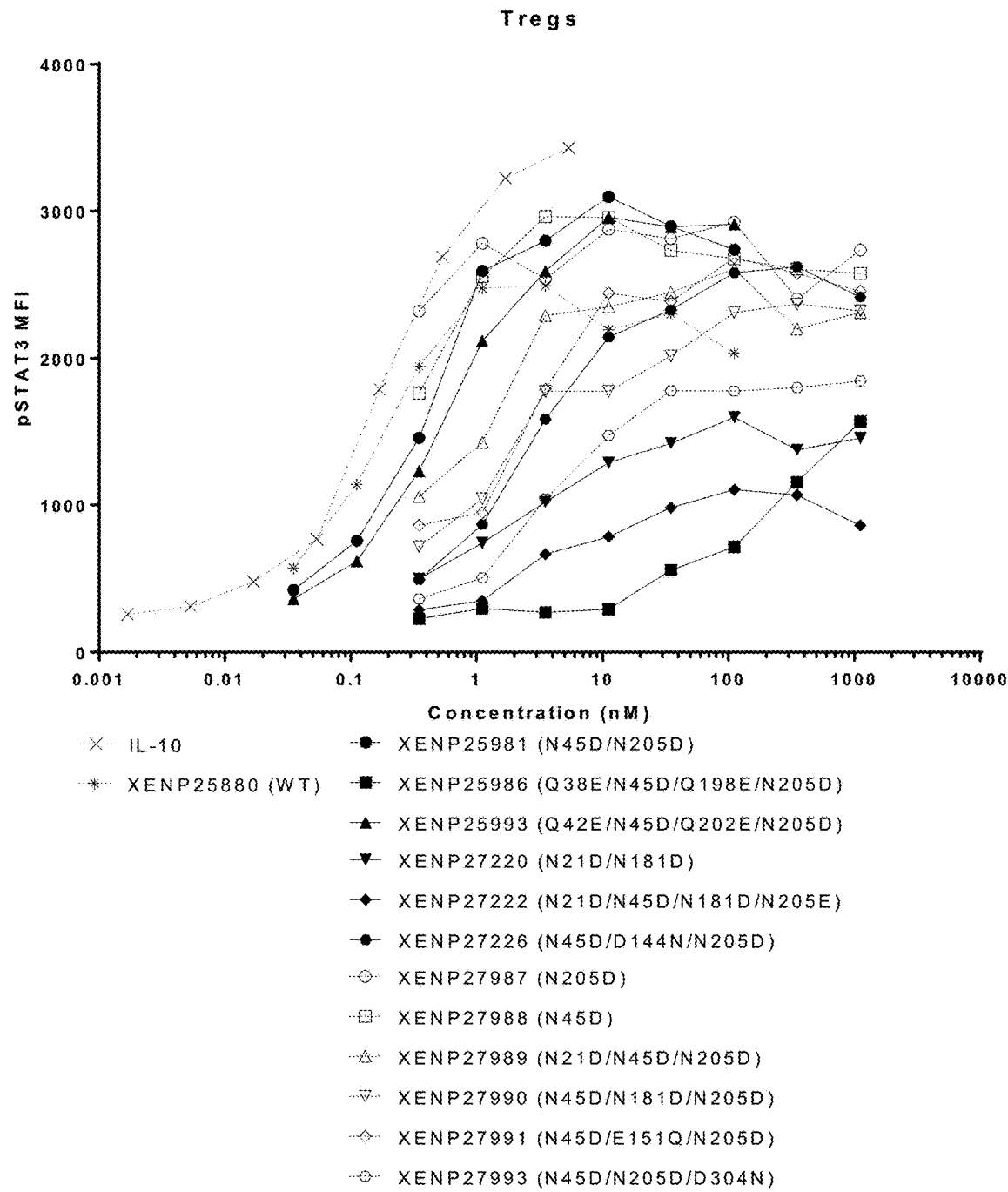

As will be appreciated by those in the art and outlined below, these sequences can be used with any IL-10 fusion formats requiring a heterodimeric Fc region. It should be noted that for C-terminal Fc fusion formats (e.g. heteroFc-scIL10), the backbones may further comprise deletion of K447 on one or both chains.

These sequences can also be used with any of the targeted IL-10 fusions of the invention requiring a heterodimeric Fc region. In targeted IL-10 fusion formats which include a variable heavy domain covalently linked to the Fc, the variable heavy domain may be covalently linked to the Fc domain by a corresponding CH1 domain and partial hinge region, illustrative sequences for which are depicted in FIG. 12, and may exclude the C220S and/or C219S substitutions.

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition or as an alternative to the skew, pI and ablation variants contained within the backbones of this Figure.

FIG. 12 depicts illustrative CH1 and partial hinge regions which may find use in covalently linking a variable domain to the backbones as depicted in FIGS. 10 and 11 in the context of particular formats of targeted IL-10 fusions.

FIG. 13 depicts the "non-Fv" backbone of cognate light chains (i.e. constant light chain) which find use in the bottle-opener and central-scFv bispecific antibodies of the invention.

FIG. 14A-14F depicts cartoon schematics for IL-10 components and configurations that find use in the IL-10 fusion proteins of the invention. FIG. 14A depicts the hIL-10(A-D) domain comprising residues 1-116 of the mature form IL-10. FIG. 14B depicts the hIL-10(E-F) domain comprising residues 117-160 of the mature form IL-10. FIG. 14C depicts the biologically active IL-10 homodimer formed by domain swapping between hIL-10(A-D) of a first IL-10 monomer and hIL-10(E-F) of a second IL-10 monomer. FIG. 14D depicts the single-chain IL-10 complex or "scIL-10" comprising a first IL-10 monomer covalently attached to a second IL-10 monomer, optionally via a linker. FIG. 14E depicts the monomeric IL-10 or "IL10M1" described by Josephson et al. (2000), which is generated by engineering a domain linker between hIL-10(A-D) and hIL-10(E-F) domains in an IL-10 monomer. FIG. 14F depicts the split IL-10 which comprises an hIL-10(A-D) domain non-covalently attached to an hIL-10(E-F) domain.

FIG. 15A-15D depicts the sequences for IL-10 components and configurations that find use in the IL-10 fusion proteins of the invention. FIG. 15A depicts the hIL-10(A-D) domain comprising residues 1-116 of the mature form IL-10. FIG. 15B depicts the hIL-10(E-F) domain comprising residues 117-160 of the mature form IL-10. FIG. 15C depicts the single-chain IL-10 complex or "scIL-10" comprising a first IL-10 monomer covalently attached to a second IL-10 monomer, although it should be noted that the scIL-10 can optionally include a linker, as is known in the art, between the first and the second IL-10 monomer. FIG. 15D depicts the monomeric IL-10 or "IL10M1" described by Josephson et al. (2000), which is generated by engineering a domain linker between hIL-10(A-D) and hIL-10(E-F) domains in an IL-10 monomer, although as will be appreciated by those in the art, the linker can be replaced by other linkers as are known in the art. It should be noted that while the IL-10 sequence depicted herein comprise 109H, the sequences can also comprise 109L, as well as sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 16A-16D depicts illustrative formats for IL-10 fusions in the IL10-Fc category. The N-terminal IL-10 Fc fusion or "(IL10)$_2$-Fc" (FIG. 16A) format comprises two identical monomers, each monomer comprising an IL-10 monomer covalently attached to the N-terminus of a homodimeric Fc chain, optionally via a domain linker (e.g., XENP24628). The C-terminal IL-10 Fc fusion or "Fc-(IL10)$_2$" (FIG. 16B) format comprises two identical monomers, each monomer comprising an IL-10 monomer covalently attached to the C-terminus of a homodimeric Fc chain, optionally via a domain linker (e.g., XENP24632). The "(IL10-NC-IL10)-heteroFc" (FIG. 16C) format comprises a first monomer comprising a first IL-10 monomer covalently attached to the N-terminus of a first heterodimeric Fc chain (optionally via a domain linker) and a second monomer comprising a complementary second heterodimeric Fc chain that is "Fc-only" or "empty-Fc", while a second IL-10 monomer is transfected separately so that a non-covalent IL-10 dimer is formed (e.g., XENP25955). The "heteroFc-(IL10-NC-IL10)" (FIG. 16D) format comprises a first monomer comprising a first IL-10 monomer covalently attached to the C-terminus of a first heterodimeric Fc chain (optionally via a domain linker) and a second monomer comprising a complementary second heterodimeric Fc chain that is "Fc-only" or "empty-Fc", while a second IL-10 monomer is transfected separately so that a domain-swapped IL-10 dimer is formed.

FIG. 17 depicts the sequences for illustrative IL-10 fusions of the IL10-Fc category in the (IL10)$_2$-Fc format (e.g., XENP24628, XENP246289, XENP24630, and XENP24631). IL-10 sequences are italicized, linkers are double underlined (although as will be appreciated by those in the art, the linkers can be replaced by other linkers), and slashes (/) indicate the border(s) between IL-10 monomer, linkers, and Fc regions. It should be noted that while the IL-10 sequence depicted herein comprise 109L, the IL-10 fusions can utilize an IL-10 sequence comprising 109H, as well as IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 18 depicts the sequences for illustrative IL-10 fusions of the IL10-Fc category in the Fc-(IL10)$_2$ format (e.g., XENP24632, XENP24633, and XENP24634). IL-10 sequences are italicized, linkers are double underlined (although as will be appreciated by those in the art, the linkers can be replaced by other linkers), and slashes (/) indicate the border(s) between IL-10 monomer, linkers, and Fc regions. It should be noted that while the IL-10 sequence depicted herein comprise 109L, the IL-10 fusion can utilize an IL-10 sequence comprising 109H, as well as IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 19 depicts the sequences for an illustrative IL-10 fusion of the IL10-Fc category in the (IL10-NC-IL10)-heteroFc format (e.g., XENP25955). IL-10 sequences are italicized, linkers are double underlined (although as will be appreciated by those in the art, the linkers can be replaced by other linkers), and slashes (/) indicate the border(s) between IL-10 monomer, linkers, and Fc regions. It should be noted that while the IL-10 sequence depicted herein comprise 109L, the IL-10 fusion can utilize an IL-10 sequence comprising 109H, as well as IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 20A-FIG. 20B depict illustrative formats for IL-10 fusions in the scIL10-Fc category, utilizing the single-chain IL-10 ("scIL10") complex as depicted in FIG. 15. The N-terminal single-chain IL-10 Fc fusion or "scIL10-heteroFc" (FIG. 20A) format comprises a first monomer comprising a scIL-10 covalently attached to the N-terminus of a first heterodimeric Fc chain (optionally via a domain linker) and a second monomer comprising a complementary second heterodimeric Fc chain that is "Fc-only" or "empty-Fc" (e.g., XENP25238). The C-terminal single-chain IL-10 Fc fusion or "heteroFc-scIL10" (FIG. 20B) format comprises a first monomer comprising a scIL-10 covalently attached to the C-terminus of a first heterodimeric Fc chain (optionally via a domain linker) and a second monomer comprising a complementary second heterodimeric Fc chain that is "Fc-only" or "empty-Fc" (e.g., XENP28740). The scIL-10 complex used in formats of this category comprise a first IL-10 monomer covalently attached to a second IL-10 monomer, optionally via a domain linker.

FIG. 21A-FIG. 21C depict the sequences for illustrative IL-10 fusions of the scIL10-Fc category in the scIL10-heteroFc format (e.g., XENP25238, XENP25239, XENP25240, XENP25241, XENP25880, and XENP28295). IL-10 sequences are underlined, linkers are double underlined (although as will be appreciated by those in the art, the linkers can be replaced by other linkers), and slashes (/) indicate the border(s) between IL-10 monomer, linkers, and Fc regions. It should be noted that while the IL-10 sequence depicted herein comprise 109L (and 269L, in the context of the scIL-10), the IL-10 fusion can utilize an IL-10 sequence comprising 109H (and 269H, in the context of the scIL-10), as well as IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 22 depicts the sequences for an illustrative IL-10 fusions of the scIL10-Fc category in the heteroFc-scIL10 format (e.g., XENP28740). IL-10 sequences are underlined, linkers are double underlined (although as will be appreciated by those in the art, the linkers can be replaced by other linkers), and slashes (/) indicate the border(s) between IL-10 monomer, linkers, and Fc regions. It should be noted that while the IL-10 sequence depicted herein comprise 109L (and 269L, in the context of the scIL-10), the IL-10 fusion can utilize an IL-10 sequence comprising 109H (and 269H, in the context of the scIL-10), as well as IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 23A-FIG. 23F depict illustrative formats for IL-10 fusions in the IL10M1-Fc category, utilizing the monomeric IL-10 (IL10M1) described by Josephson et al. (2000) as depicted in FIGS. 14 and 15. The N-terminal bivalent IL10M1 Fc fusion or "(IL10M1)2-Fc" (FIG. 23A) format comprises two identical monomers, each monomer comprising an IL10M1 covalently attached to the N-terminus of a homodimeric Fc chain, optionally via a domain linker (e.g., XENP25326). The C-terminal bivalent IL10M1 Fc fusion or "Fc-(IL10M1)$_2$" (FIG. 23B) format comprises two identical monomers, each monomer comprising an IL10M1 covalently attached to the C-terminus of a homodimeric Fc chain, optionally via a domain linker (e.g., XENP25327). The one-arm N-terminal bivalent IL10M1 Fc fusion or "(IL10M1)$_2$-heteroFc" (FIG. 23C) format comprises a first monomer comprising a first IL10M1 covalently attached to a second IL10M1 (optionally via a linker) further covalently attached to the N-terminus of a first heterodimeric Fc chain (optionally via a linker), and a second monomer comprising a complementary second heterodimeric Fc chain that is "Fc-only" or "empty-Fc". The one-arm C-terminal bivalent IL10M1 Fc fusion or "heteroFc-(IL10M1)$_2$" (FIG. 23D) format comprises a first monomer comprising a first IL10M1 covalently attached to a second IL10M1 (optionally via a linker) further covalently attached to the C-terminus of a first heterodimeric Fc chain (optionally via a linker), and a second monomer comprising a complementary second heterodimeric Fc chain that is "Fc-only" or "empty-Fc". The N-terminal monovalent IL10M1 fusion or "(IL10M1)$_1$-heteroFc" (FIG. 23E) format comprises an IL10M1 covalently attached to the N-terminus of a first heterodimeric Fc chain (optionally via a linker), and a second monomer comprising a complementary second heterodimeric Fc chain that is "Fc-only" or "empty-Fc". The C-terminal monovalent IL10M1 fusion or "heteroFc-(IL10M1)$_1$" (FIG. 23F) format comprises an IL10M1 covalently attached to the C-terminus of a first heterodimeric Fc chain (optionally via a linker), and a second monomer comprising a complementary second heterodimeric Fc chain that is "Fc-only" or "empty-Fc". The IL10M1 used in formats of this category is generated by engineering a domain linker between helices D and E of an IL-10 monomer.

FIG. 24 depicts the sequences for an illustrative IL-10 fusion of the IL10M1-Fc category in the (IL10M1)$_1$-heteroFc format (e.g., XENP14246). IL-10M1 sequences are italicized, linkers are double underlined (although as will be appreciated by those in the art, the linkers can be replaced by other linkers), and slashes (/) indicate the border(s) between IL10M1, linkers, and Fc regions. It should be noted that while the IL10M1 sequence depicted herein comprise 109H (numbered according to mature form IL-10 monomer without an internal linker), the IL-10 fusion can utilize an IL10M1 sequence comprising 109L, as well as IL10M1 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 25 depicts the sequences for an illustrative IL-10 fusion of the IL10M1-Fc category in the heteroFc-(IL10M1)$_1$ format (e.g., XENP14247). IL-10M1 sequences are italicized, linkers are double underlined (although as will be appreciated by those in the art, the linkers can be replaced by other linkers), and slashes (/) indicate the border(s) between IL10M1, linkers, and Fc regions. It should be noted that while the IL10M1 sequence depicted herein comprise 109H (numbered according to mature form IL-10 monomer without an internal linker), the IL-10 fusion can utilize an IL10M1 sequence comprising 109L, as well as IL10M1 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 26 depicts the sequences for an illustrative IL-10 fusion of the IL10M1-Fc category in the (IL10M1)$_2$-Fc format (e.g., XENP25236). IL-10M1 sequences are italicized, linkers are double underlined (although as will be appreciated by those in the art, the linkers can be replaced by other linkers), and slashes (/) indicate the border(s) between IL10M1, linkers, and Fc regions. It should be noted that while the IL10M1 sequence depicted herein comprise 109H (numbered according to mature form IL-10 monomer without an internal linker), the IL-10 fusion can utilize an IL10M1 sequence comprising 109L, as well as IL10M1 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 27 depicts the sequences for an illustrative IL-10 fusion of the IL10M1-Fc category in the Fc-(IL10M1)$_2$ format (e.g., XENP25237). IL-10M1 sequences are italicized, linkers are double underlined (although as will be appreciated by those in the art, the linkers can be replaced by other linkers), and slashes (/) indicate the border(s) between IL10M1, linkers, and Fc regions. It should be noted that while the IL10M1 sequence depicted herein comprise 109H (numbered according to mature form IL-10 monomer without an internal linker), the IL-10 fusion can utilize an IL10M1 sequence comprising 109L, as well as IL10M1 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 28 depicts the sequences for an illustrative IL-10 fusion of the IL10M1-Fc category in the (IL10M1)$_2$-heteroFc format (e.g., XENP26887). IL-10M1 sequences are italicized, linkers are double underlined (although as will be appreciated by those in the art, the linkers can be replaced by other linkers), and slashes (/) indicate the border(s) between IL10M1, linkers, and Fc regions. It should be noted that while the IL10M1 sequence depicted herein comprise 109H (numbered according to mature form IL-10 monomer without an internal linker), the IL-10 fusion can utilize an IL10M1 sequence comprising 109L, as well as IL10M1 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 29A-FIG. 29D depicts illustrative formats for IL-10 fusions in the splitIL10-Fc category, utilizing hIL-10(A-D) and hIL-10(E-F) domains as depicted in FIGS. 14A-14F and 15A-15D. The N-terminal monovalent splitIL-10 Fc fusion or "(splitIL10)$_1$-heteroFc" (FIG. 29A) comprises a first monomer comprising a hIL-10(A-D) domain covalently attached to the N-terminus of a first heterodimeric Fc chain (optionally via a linker) and a second monomer comprising a hIL-10(E-F) domain covalently attached the N-terminus of a complementary second heterodimeric Fc chain (optionally via a linker) (e.g., XENP25242). The C-terminal monovalent splitIL-10 Fc fusion or "heteroFc-(splitIL10)$_1$" (FIG. 29B) comprises a first monomer comprising a hIL-10(A-D) domain covalently attached to the C-terminus of a first heterodimeric Fc chain (optionally via a linker) and a second monomer comprising a hIL-10(E-F) domain covalently attached the C-terminus of a complementary second heterodimeric Fc chain (optionally via a linker). The N-terminal bivalent splitIL-10 Fc fusion or "(splitIL10)$_2$-heteroFc" (FIG. 29C) comprises a first monomer comprising a first hIL-10(A-D) domain covalently attached to a second hIL-10(A-D) domain (optionally via a linker) further covalently attached to the N-terminus of a first heterodimeric Fc chain (optionally via a linker) and a second monomer comprising a first hIL-10(E-F) domain covalently attached to a second hIL-10(E-F) domain (optionally via a domain linker) further covalently attached to the N-terminus of a complementary second heterodimeric Fc chain (optionally via a linker). The C-terminal bivalent splitIL-10 Fc fusion or "heteroFc-(splitIL10)$_2$" (FIG. 29D) comprises a first monomer comprising a first hIL-10(A-D) domain covalently attached to a second hIL-10(A-D) domain (optionally via a linker) further covalently attached to the C-terminus of a first heterodimeric Fc chain (optionally via a linker) and a second monomer comprising a first hIL-10(E-F) domain covalently attached to a second hIL-10(E-F) domain (optionally via a domain linker) further covalently attached to the C-terminus of a complementary second heterodimeric Fc chain (optionally via a linker).

FIG. 30 depicts the sequences for illustrative IL-10 fusion of the splitIL10-Fc category in the splitIL10-heteroFc format (e.g., XENP25242, XENP25243, and XENP25244). Sequences of IL-10 components are italicized, linkers are double underlined (although as will be appreciated by those in the art, the linkers can be replaced by other linkers), and slashes (/) indicate the border(s) between IL-10 components, linkers, and Fc regions. It should be noted that while the hIL-10(A-D) sequence depicted herein comprise 109L (numbered according to mature form IL-10 monomer), the IL-10 fusion can utilize an hIL-10(A-D) sequence comprising 109H. Further, the IL-10 fusion can utilize hIL-10(A-D) and/or hIL-10(E-F) sequences that are 90, 95, 98 and 99% identical (as defined herein), and/or contain from 1, 2, 3, 4, 5, 6, 7, 8, 9 or 10 amino acid substitutions, including substitutions to modulate affinity/potency, introduce/remove disulfide bridges, improve yield, remove charge variants, remove glycosylation sites, and/or improve stability.

FIG. 31 depicts the sequences for illustrative IL-10 fusion of the splitIL10-Fc category in the heteroFc-splitIL10 format (e.g., XENP25879). Sequences of IL-10 components are italicized, linkers are double underlined (although as will be appreciated by those in the art, the linkers can be replaced by other linkers), and slashes (/) indicate the border(s) between IL-10 components, linkers, and Fc regions. It should be noted that while the hIL-10(A-D) sequence depicted herein comprise 109L (numbered according to mature form IL-10 monomer), the IL-10 fusion can utilize an hIL-10(A-D) sequence comprising 109H. Further, the IL-10 fusion can utilize hIL-10(A-D) and/or hIL-10(E-F) sequences that are 90, 95, 98 and 99% identical (as defined herein), and/or contain from 1, 2, 3, 4, 5, 6, 7, 8, 9 or 10 amino acid substitutions, including substitutions to modulate affinity/potency, introduce/remove disulfide bridges, improve yield, remove charge variants, remove glycosylation sites, and/or improve stability.

FIG. 32A-FIG. 32C depict A) chromatogram illustrating purification part 2 of XENP25880 (cation exchange chromatography following protein A chromatography), and the purity and homogeneity of peak B isolated from cation exchange separation as depicted in FIG. 32A in comparison to peak BC as determined by B) analytical size-exclusion chromatography with multi-angle light scattering (aSEC-MALS) and C) analytical cation exchange chromatography (aCIEX). FIG. 32B also depicts the molecular weight of protein species in peaks as determined by multi-angle light scattering.

FIG. 33A-FIG. 33E depict induction of STAT3 phosphorylation by IL-10 fusion proteins in the IL10-Fc format (XENP24628), scIL10-Fc format (XENP25880), IL10M1-Fc format (XENP25236), and splitIL10-Fc format (XENP25242) as well as recombinant IL-10 control on A) $CD4^+CD25^+CD45RA^-$ T cells, B) $CD4^+CD25^{int}CD45RA^+$ T cells, C) $CD8^+CD25^+CD45RA^-$ T cells, D) $CD8^+CD25^{int}CD45RA^+$ T cells, and E) Tregs. The data show that IL-10 fusions in the scIL0-Fc format (XENP25880) induced STAT3 phosphorylation on various lymphocyte populations.

FIG. 34A-FIG. 34E depict induction of STAT3 phosphorylation by IL-10 fusion proteins with N-terminal IL-10 (XENP25981) and C-terminal IL-10 (XENP28741) as well as recombinant IL-10 control on A) $CD4^+CD45RA^-$ T cells, B) $CD4^+CD45RA^+$ T cells, C) $CD8^+CD45RA^-$ T cells, D) $CD8^+CD45RA^+$ T cells, and E) Tregs. The data show that C-terminal Fc fusion XENP28741 induced STAT3 phosphorylation more potently than N-terminal Fc fusion XENP25981.

FIG. 35A-FIG. 35D depict sequences for illustrative IL-10 monomer variants designed with the aim to reduce their affinity for the IL-10 receptor complex and/or to reduce their potency. It should be noted that these IL-10 variant sequences are based on the IL-10(109L) sequence, although they can be based on the IL-10(109H) sequence. Each of the substitutions herein can be used alone or in combination with any other substitutions depicted herein. Additionally, as will be clear to those skilled in the art, while the substitutions herein are depicted in the context of an IL-10 monomer, each of the substitutions can be used alone or in combination in the context of IL-10 domains (e.g. hIL-10(A-D) and hIL-10(E-F)), scIL-10, and IL10M1. Further, each of the substitutions depicted in this Figure can be used alone or in combination with any other substitutions depicted herein, including substitutions to modulate affinity/potency, introduce/remove disulfide bridges, improve yield, remove charge variants, remove glycosylation sites, and/or improve stability.

FIG. 36A-FIG. 36D depict sequences for illustrative IL10M1 variants designed with the aim to reduce their affinity for the IL-10 receptor complex and/or to reduce their potency. It should be noted that these IL-10 variant sequences are based on the IL-10(109H) sequence, although they can be based on the IL-10(109L) sequence. Each of the substitutions depicted in this Figure can be used alone or in combination with any other substitutions depicted herein, including substitutions to modulate affinity/potency, introduce/remove disulfide bridges, improve yield, remove charge variants, remove glycosylation sites, and/or improve stability.

FIG. 37A-FIG. 37E depict the sequences illustrative IL-10 fusions of the IL10M1-Fc category in the (IL10M1)$_1$-heteroFc format comprising IL10M1 variants engineered with the aim to reduce affinity and potency. IL-10M1 sequences are underlined, linkers are double underlined (although as will be appreciated by those in the art, the linkers can be replaced by other linkers), and slashes (/) indicate the border(s) between IL10M1, linkers, and Fc regions. It should be noted that while the IL10M1 sequence depicted herein comprise 109H (numbered according to mature form IL-10 monomer without an internal linker), the IL-10 fusion can utilize an IL10M1 sequence comprising 109L, as well as IL10M1 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 38 depicts the dissociation constant ($K_D$), association rate ($k_a$), and dissociation rate ($k_d$) of (IL10M1)$_1$-heteroFc fusions comprising affinity-engineered IL10M1 variants binding to human IL-10R1 as determined by Octet, a BLI-based method. Bivalent human IL-10-Fc were captured on AR2G biosensors and dipped into multiple concentrations of the indicated test articles. * indicates poor fits from biphasic sensorgrams. The data show that we engineered IL-10 variants with a range of affinities for IL-10R1.

FIG. 39A-FIG. 39G depict sequences for illustrative scIL-10 variants designed with the aim to reduce their affinity for the IL-10 receptor complex and/or to reduce their potency. It should be noted that these IL-10 variant sequences are based on the IL-10(109L) sequence, although they can also be based on the IL-10(109H) sequence. Each of the substitutions depicted in this Figure can be used alone or in combination with any other substitutions depicted herein, including substitutions to modulate affinity/potency, introduce/remove disulfide bridges, improve yield, remove charge variants, remove glycosylation sites, and/or enhance stability. It should also be noted that these scIL-10 variants can optionally include a linker between each IL-10 sequence, although numbering of the substitutions would be based on the full-length scIL-10 sequence as depicted in FIG. 15C FIG. 40A-FIG. 40N depict the sequences illustrative IL-10 fusions of the scIL10-Fc category in the scIL10- heteroFc format comprising scIL-10 variants engineered with the aim to reduce affinity and potency. IL-10 sequences are underlined, linkers are double underlined (although as will be appreciated by those in the art, the linkers can be replaced by other linkers), and slashes (/) indicate the border(s) between IL-10 monomer, linkers, and Fc regions. It should be noted that while the IL-10 sequence depicted herein comprise 109L (and 269L, in the context of the scIL-10), the IL-10 fusion can utilize an IL-10 sequence comprising 109H (and 269H, in the context of the scIL-10), as well as IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 41A-FIG. 41G depict the sequences illustrative IL-10 fusions of the scIL10-Fc category in the heteroFc-scIL10 format comprising scIL-10 variants engineered with the aim to reduce affinity and potency. IL-10 sequences are underlined, linkers are double underlined (although as will be appreciated by those in the art, the linkers can be replaced by other linkers), and slashes (/) indicate the border(s) between IL-10 monomer, linkers, and Fc regions. It should be noted that while the IL-10 sequence depicted herein comprise 109L (and 269L, in the context of the scIL-10), the IL-10 fusion can utilize an IL-10 sequence comprising 109H (and 269H, in the context of the scIL-10), as well as IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 42A-FIG. 42E depicts induction of STAT3 phosphorylation by scIL10-heteroFc fusions comprising affinity-engineered scIL-10 variants on A) $CD4^+CD45RA^-$ T cells, B) $CD4^+CD45RA^+$ T cells, C) $CD8^+CD45RA^-$ T cells, D) $CD8^+CD45RA^+$ T cells, and E) Tregs. The data illustrates that we engineered IL-10 fusions with a wide range of potencies (as indicated by induction of STAT3 phosphorylation).

Figure 43A:
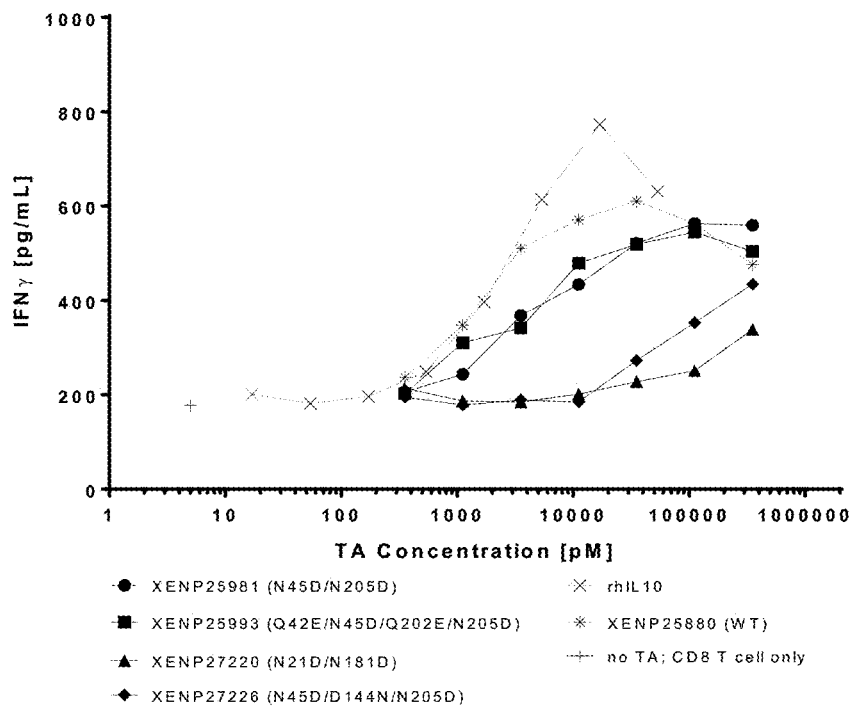
Figure 43B:
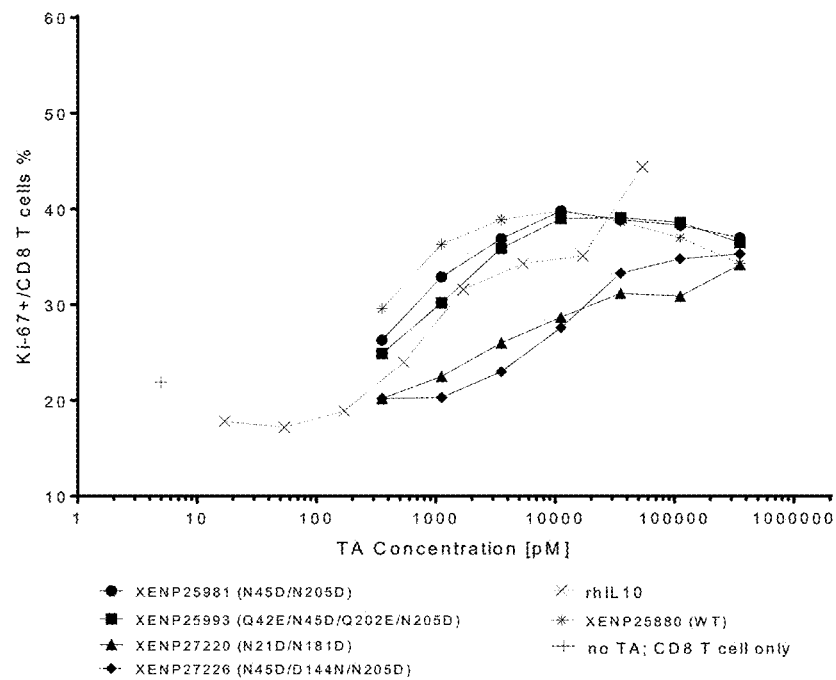
Figure 43C:
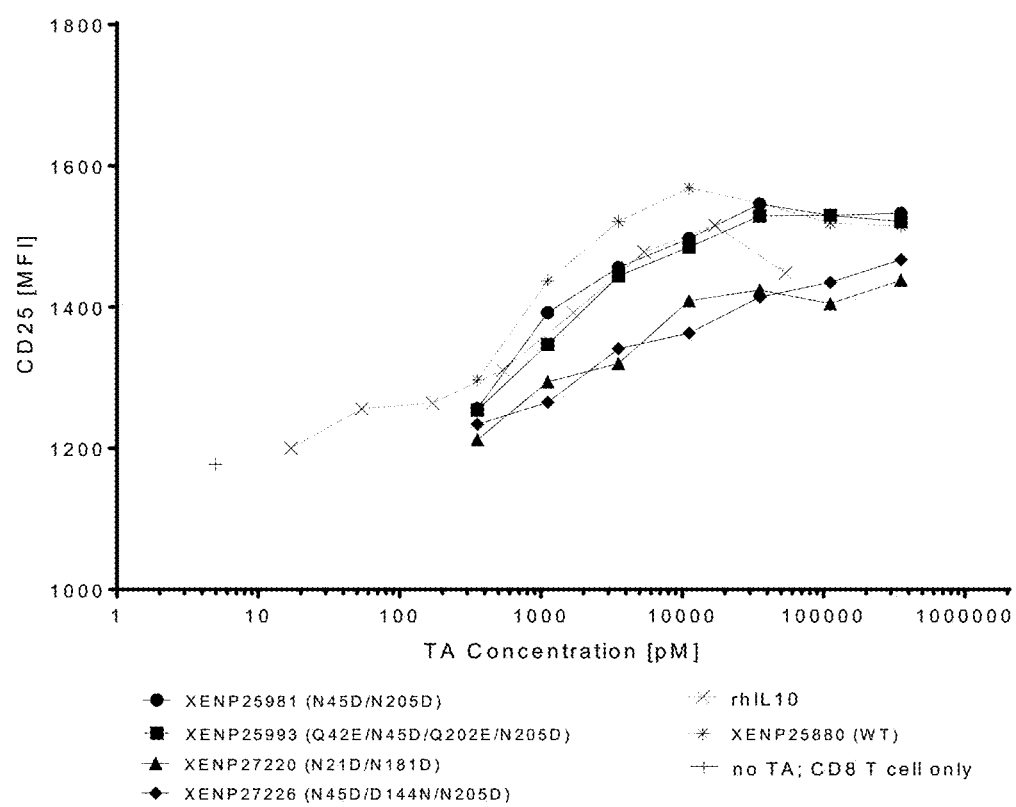

FIG. 43A-FIG. 43C depict the potentiation of A) IFNγ secretion, B) proliferation (as indicated by percentage cells expressing Ki67), and C) activation (as indicated by CD25 expression) of purified $CD8^+$ T cells by scIL10-heteroFc fusions comprising affinity-engineered scIL-10 variants. The data show that IL-10 fusion proteins of the invention potentiate IFNγ secretion by $CD8^+$ T cells, activation of $CD8^+$ T cells, and proliferation of $CD8^+$ T cells.

Figure 44A:
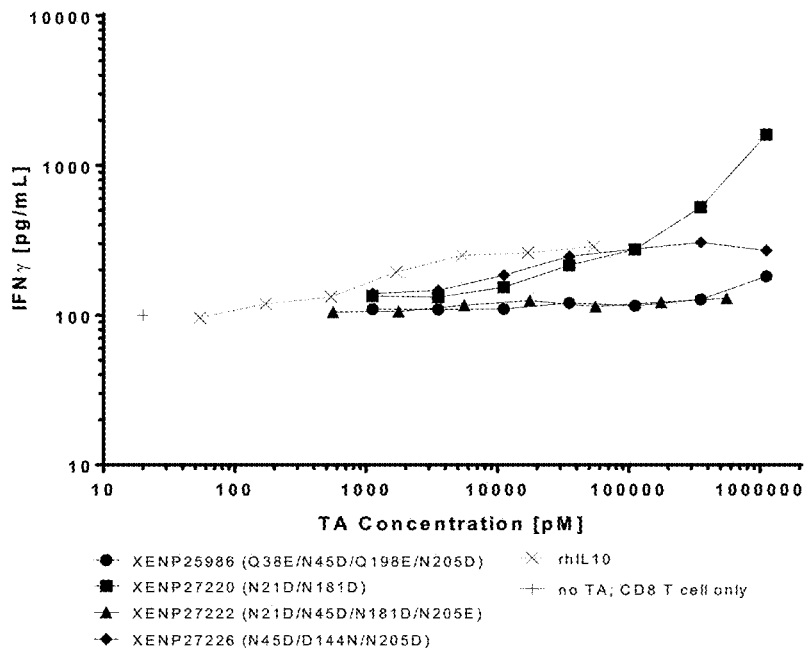
Figure 44B:
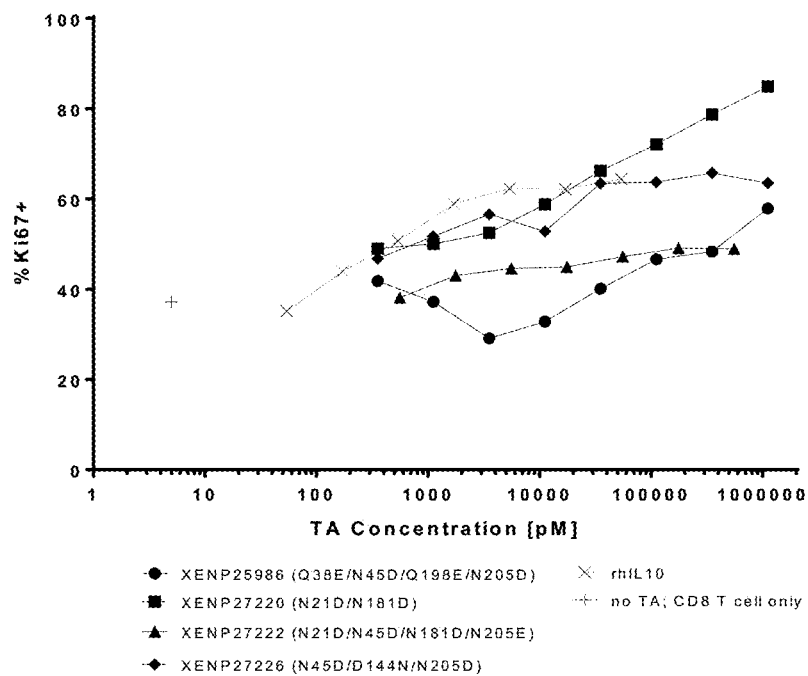
Figure 44C:
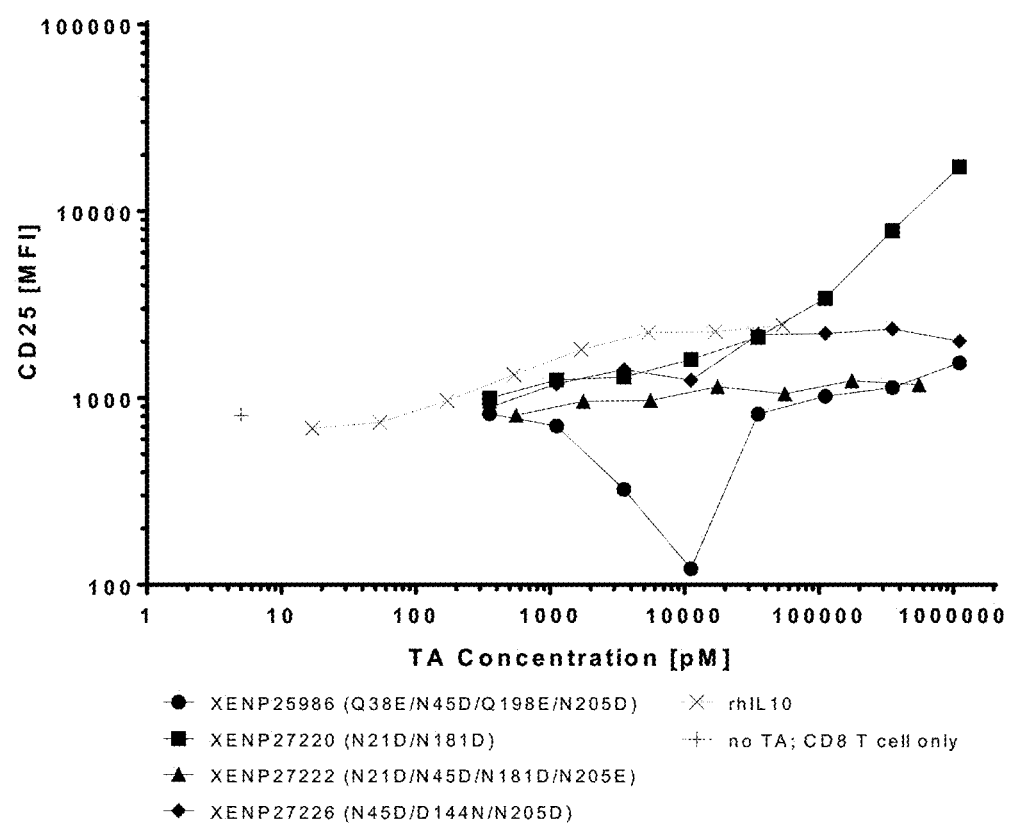

FIG. 44A-FIG. 44C depict the potentiation of A) IFNγ secretion, B) proliferation (as indicated by percentage cells expressing Ki67), and C) activation (as indicated by CD25 expression) of purified $CD8^+$ T cells by scIL10-heteroFc fusions comprising additional affinity-engineered scIL-10 variants. The data show that IL-10 fusion proteins of the invention potentiate IFNγ secretion by $CD8^+$ T cells, activation of $CD8^+$ T cells, and proliferation of $CD8^+$ T cells.

Figure 45A:
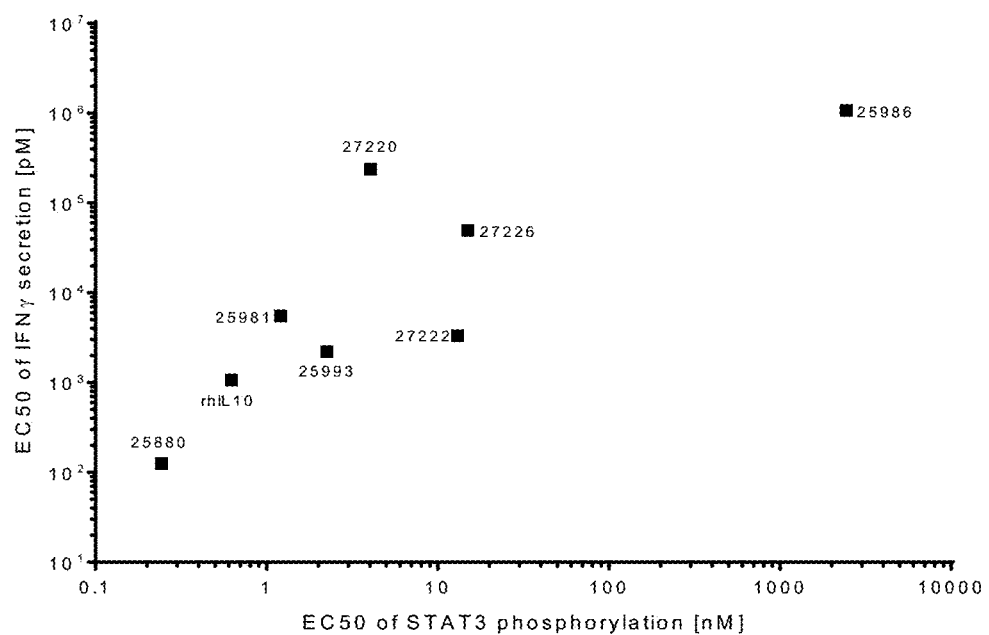
Figure 45B:
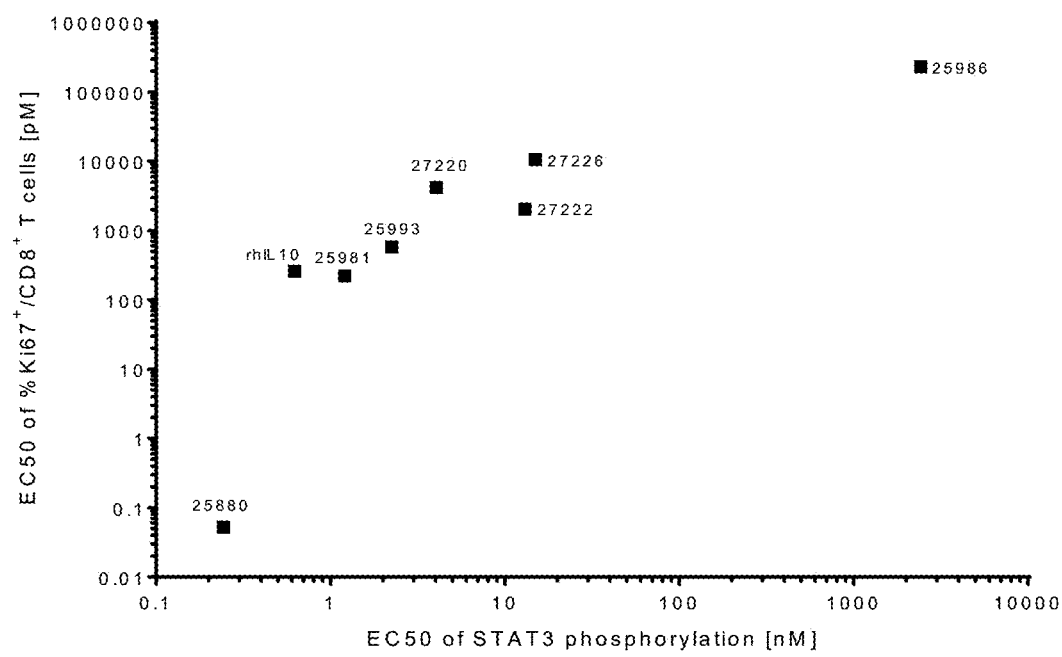
Figure 45C:
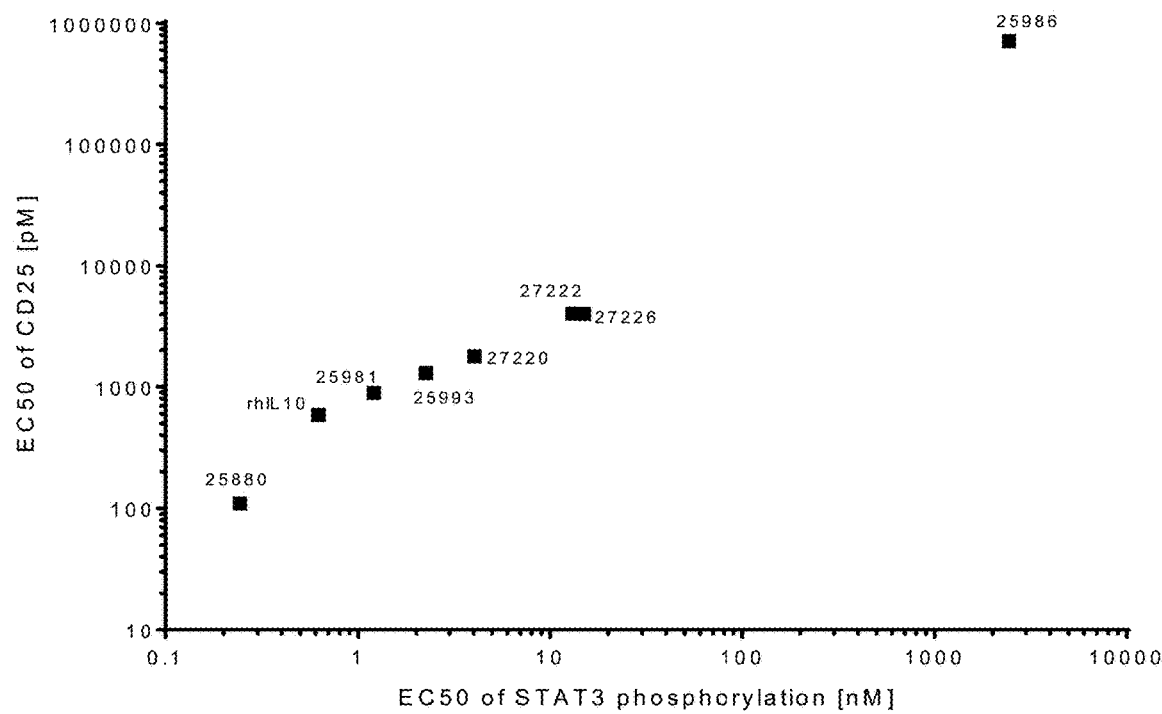

FIG. 45A-FIG. 45C depict the correlation between the EC50 for A) IFNγ secretion, B) proliferation, and C) activation of $CD8^+$ T cells and EC50 for induction of STAT3 phosphorylation by scIL10-heteroFc fusions comprising additional affinity-engineered scIL-10 variants. The data show that the EC50 for induction of STAT3 phosphorylation correlated well with the EC50 for potentiation of IFNγ secretion, activation of $CD8^+$ T cells, and proliferation of $CD8^+$ T cells.

FIG. 46A-FIG. 46C depict A) chromatogram illustrating purification part 2 of XENP25238 (cation exchange chromatography following protein A chromatography), and the purity and homogeneity of peak B isolated from cation exchange separation as depicted in FIG. 46A in comparison to peak BC as determined by B) analytical size-exclusion chromatography with multi-angle light scattering (aSEC-MALS) and C) analytical cation exchange chromatography (aCIEX). FIG. 46B also depicts the molecular weight of protein species in peaks as determined by multi-angle light scattering.

FIG. 47A-FIG. 47E depicts induction of STAT3 phosphorylation by scIL10-heteroFc fusion proteins with the scIL-10 complex on the heterodimeric Fc chain with a lower pI (XENP25238) and on the heterodimeric chain with a higher pI (XENP25880) on A) $CD4^+CD25^+CD45RA^-$ T cells, B) $CD4^+CD25^{int}CD45RA^+$ T cells, C) $CD8^+CD25^+CD45RA^-$ T cells, D) $CD8^+CD25^{int}CD45RA^+$ T cells, and E) Tregs.

FIG. 48 depicts illustrative sequences for single-chain IL-10 complexes (scIL-10) comprising domain linkers between the first IL-10 monomer and the second IL-10 monomer. IL-10 sequences are underlined, linkers are double underlined (although as will be appreciated by those in the art, the linkers can be replaced by other linkers), and slashes (/) indicate the border(s) between IL-10 monomers and linker. It should be noted that while the IL-10 sequence depicted herein comprise 109L (and 269L, in the context of the full-length scIL-10), the IL-10 fusion can utilize an IL-10 sequence comprising 109H (and 269H, in the context of the scIL-10), as well as IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 49A-FIG. 49B depicts the sequences for illustrative IL-10 fusions of the scIL10-Fc category in the scIL10-heteroFc format comprising scIL-10 complexes having domain linkers between the first and the second IL-10 monomer. IL-10 sequences are underlined, linkers are double underlined (although as will be appreciated by those in the art, the linkers can be replaced by other linkers), and slashes (/) indicate the border(s) between IL-10 monomer, linkers, and Fc regions. It should be noted that while the IL-10 sequence depicted herein comprise 109L (and 269L, in the context of the scIL-10), the IL-10 fusion can utilize an IL-10 sequence comprising 109H (and 269H, in the context of the scIL-10). Additionally, while the IL-10 sequences depicted herein are wild-type, the IL-10 fusions can utilize IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 50A-FIG. 50E depict induction of STAT3 phosphorylation by scIL10-heteroFc fusion proteins with no linker (XENP25238), a $G_4S$ linker (SEQ ID NO: 31) (XENP25239), a $(G_4S)_2$ linker (SEQ ID NO: 32) (XENP25240), and a $(G_4S)_3$ linker (SEQ ID NO: 33) (XENP25241) engineered within the scIL-10 complex on A) $CD4^+CD25^+CD45RA^-$ T cells, B) $CD4^+CD25^{int}CD45RA^+$ T cells, C) CD8⁺CD25⁺CD45RA⁻ T cells, D) CD8⁺ CD25$^{int}$CD45RA⁺ T cells, and E) Tregs.

Figure 51A:
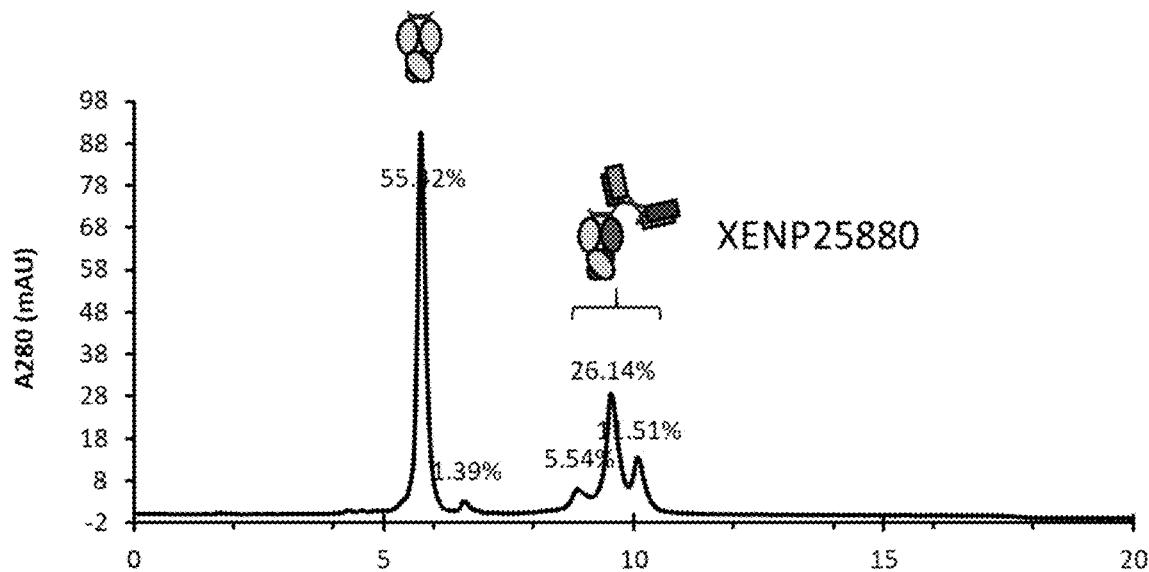
Figure 51B:
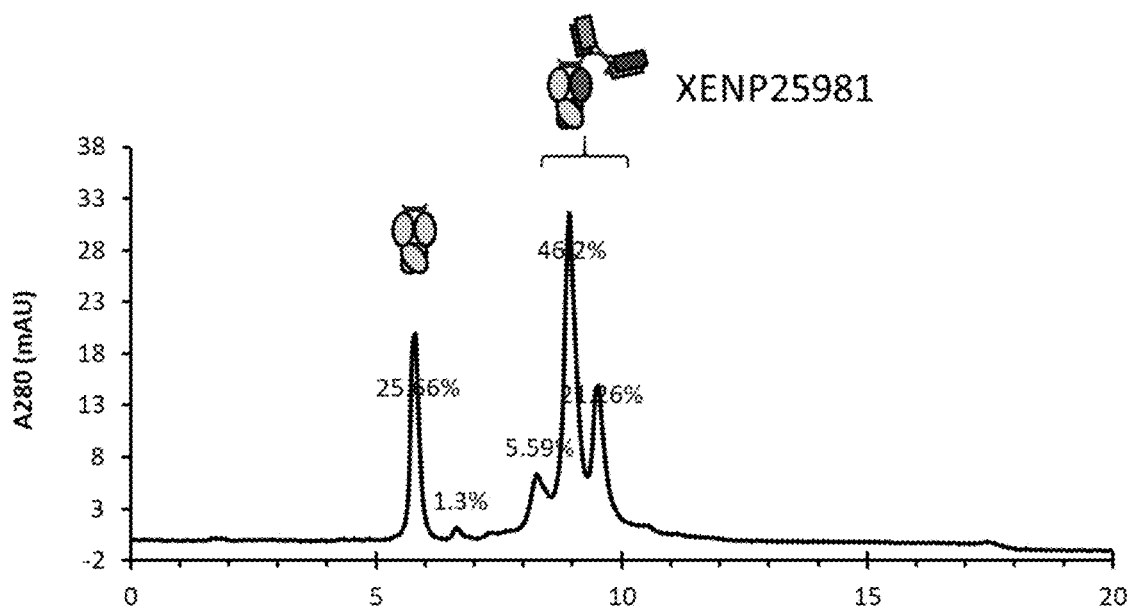

FIG. 51A-FIG. 51B depict the analytical cation exchange separation profile for Protein A purified (purification part 1) samples of A) XENP25880 and B) XENP25981 from production batch 20180213.

FIG. 52 depicts total protein yield (all protein as purified by Protein A in purification part 1; mg/L), percent homodimer and percent heterodimer (as determined by analytical cation exchange separation of Protein A purified material), and homodimer and heterodimer yield (calculated based on total protein yield and percentage homodimer or heterodimer) for various production batches of XENP25880 and XENP25981. The data show that production of XENP25981 generally resulted in greater yield of the scIL10-heteroFc fusion over empty-Fc homodimer suggesting that the N45D substitution enhanced heterodimer yield.

FIG. 53 depicts the sequences for XENP25986 and XENP25993, illustrative variant scIL10-heteroFc fusions having N45D and N205D modifications. IL-10 sequences are underlined, linkers are double underlined (although as will be appreciated by those in the art, the linkers can be replaced by other linkers), and slashes (/) indicate the border(s) between IL-10 monomer, linkers, and Fc regions. It should be noted that while the IL-10 sequence depicted herein comprise 109L (and 269L, in the context of the scIL-10), the IL-10 fusion can utilize an IL-10 sequence comprising 109H (and 269H, in the context of the scIL-10). Additionally, the IL-10 fusions can utilize IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 54 depicts total protein yield (all protein as purified by Protein A in purification part 1; mg/L), percent homodimer and percent heterodimer (as determined by analytical cation exchange separation of Protein A purified material), and homodimer and heterodimer yield (calculated based on total protein yield and percentage homodimer or heterodimer) for XENP25880, XENP25981, XENP25986, and XENP25993 from production batch 20180213. The data show that scIL10-heteroFc fusions comprising IL-10 variants with N45D (and N205D) substitution had enhanced heterodimer yield.

FIG. 55 depicts sequences for illustrative IL-10 monomer variants designed with the aim to remove potential for deamidation. It should be noted that these IL-10 variant sequences are based on the IL-10(109L) sequence, although they can be based on the IL-10(109H) sequence. Each of the substitutions herein can be used alone or in combination with any other substitutions depicted herein, including substitutions to modulate affinity/potency, introduce/remove disulfide bridges, improve yield, remove charge variants, remove glycosylation sites, and/or improve stability. Additionally, as will be clear to those skilled in the art, while the substitutions herein are depicted in the context of an IL-10 monomer, each of the substitutions can be used alone or in combination in the context of IL-10 domains (e.g. hIL-10 (A-D) and hIL-10(E-F)), scIL-10, and IL10M1.

FIG. 56A-FIG. 56C depict sequences for illustrative scIL-10 variants designed with the aim to remove potential for deamidation. It should be noted that these IL-10 variant sequences are based on the IL-10(109L) sequence, although they can also be based on the IL-10(109H) sequence. It should also be noted that while these IL-10 variant sequences include N45D substitution for improving yield, they can be used without N45D substitution. Each of the substitutions depicted in this Figure can be used alone or in combination with any other substitutions depicted herein, including substitutions to modulate affinity/potency, introduce/remove disulfide bridges, improve yield, remove charge variants, remove glycosylation sites, and/or improve stability. It should also be noted that these scIL-10 variants can optionally include a linker between each IL-10 sequence, although numbering of the substitutions would be based on the full-length scIL-10 sequence as depicted in FIGS. 15A-15D.

FIG. 57 depicts sequences for illustrative IL-10 monomer variants designed with the aim to remove potential for aspartic acid isomerization. It should be noted that these IL-10 variant sequences are based on the IL-10(109L) sequence, although they can be based on the IL-10(109H) sequence. Each of the substitutions herein can be used alone or in combination with any other substitutions depicted herein, including substitutions to modulate affinity/potency, introduce/remove disulfide bridges, improve yield, remove charge variants, remove glycosylation sites, and/or improve stability. Additionally, as will be clear to those skilled in the art, while the substitutions herein are depicted in the context of an IL-10 monomer, each of the substitutions can be used alone or in combination in the context of IL-10 domains (e.g. hIL-10(A-D) and hIL-10(E-F)), scIL-10, and IL10M1.

FIG. 58 depicts sequences for illustrative scIL-10 variants designed with the aim to remove potential for aspartic acid isomerization. It should be noted that these IL-10 variant sequences are based on the IL-10(109L) sequence, although they can also be based on the IL-10(109H) sequence. It should also be noted that while these IL-10 variant sequences include N45D substitution for improving yield, they can be used without N45D substitution. Each of the substitutions depicted in this Figure can be used alone or in combination with any other substitutions depicted herein, including substitutions to modulate affinity/potency, introduce/remove disulfide bridges, improve yields, remove charge variants, remove glycosylation sites, and/or improve stability. It should also be noted that these scIL-10 variants can optionally include a linker between each IL-10 sequence, although numbering of the substitutions would be based on the full-length scIL-10 sequence as depicted in FIGS. 15A-FIG. 15D.

FIG. 59A-FIG. 59H depict the sequences illustrative IL-10 fusions of the scIL10-Fc category in the scIL10-heteroFc format comprising scIL-10 variants engineered with the aim to remove potential for degradation-related PTMs. IL-10 sequences are underlined, linkers are double underlined (although as will be appreciated by those in the art, the linkers can be replaced by other linkers), and slashes (/) indicate the border(s) between IL-10 monomer, linkers, and Fc regions. It should be noted that while the IL-10 sequence depicted herein comprise 109L (and 269L, in the context of the scIL-10), the IL-10 fusion can utilize an IL-10 sequence comprising 109H (and 269H, in the context of the scIL-10), as well as IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 60 depicts the sequences illustrative IL-10 fusions of the scIL10-Fc category in the heteroFc-scIL10 format comprising scIL-10 variants engineered with the aim to remove potential for degradation-related PTMs. IL-10 sequences are underlined, linkers are double underlined (although as will be appreciated by those in the art, the linkers can be replaced by other linkers), and slashes (/) indicate the border(s) between IL-10 monomer, linkers, and Fc regions. It should be noted that while the IL-10 sequence depicted herein comprise 109L (and 269L, in the context of the scIL-10), the IL-10 fusion can utilize an IL-10 sequence comprising 109H (and 269H, in the context of the scIL-10), as well as IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 61A-FIG. 61D depict the analytical cation exchange separation profile for Protein A purified (purification part 1) samples of A) XENP25981, B) XENP28641, and C) XENP28635, illustrating the removal of charged variants.

FIG. 62A-FIG. 62E depict the induction of STAT3 phosphorylation by scIL10-heteroFc fusions comprising scIL-10 variants engineered to remove potential degradation sites on A) CD4+CD45RA− T cells, B) CD4+CD45RA+ T cells, C) CD8+CD45RA− T cells, D) CD8+CD45RA+ T cells, and E) Tregs. The data shows that scIL-10 variants engineered to remove potential degradation sites did not lose their activity.

Figure 63A:
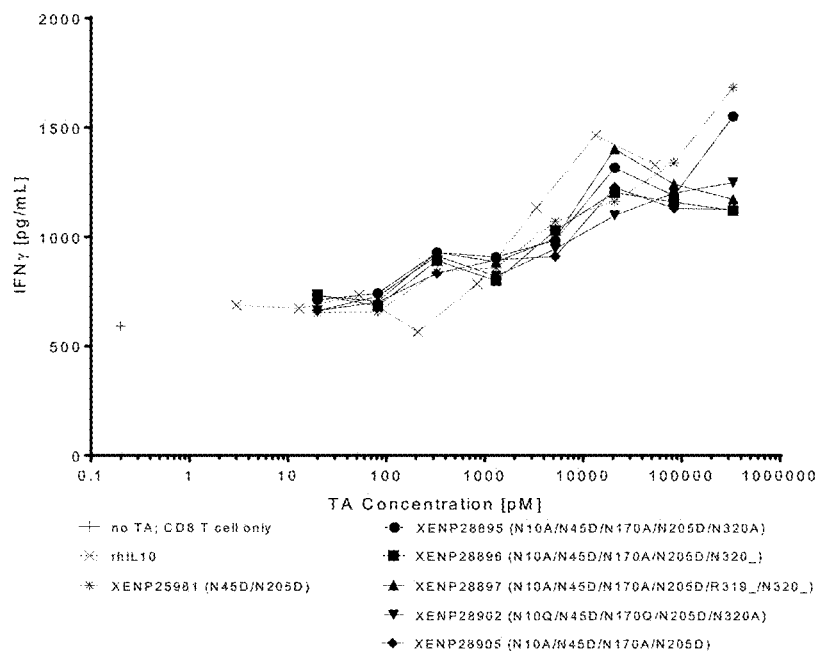
Figure 63B:
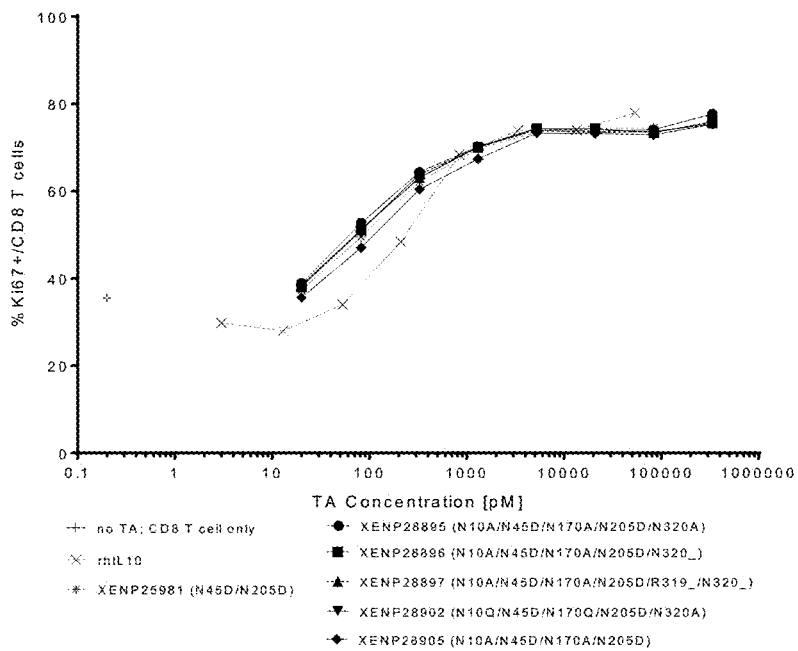
Figure 63C:
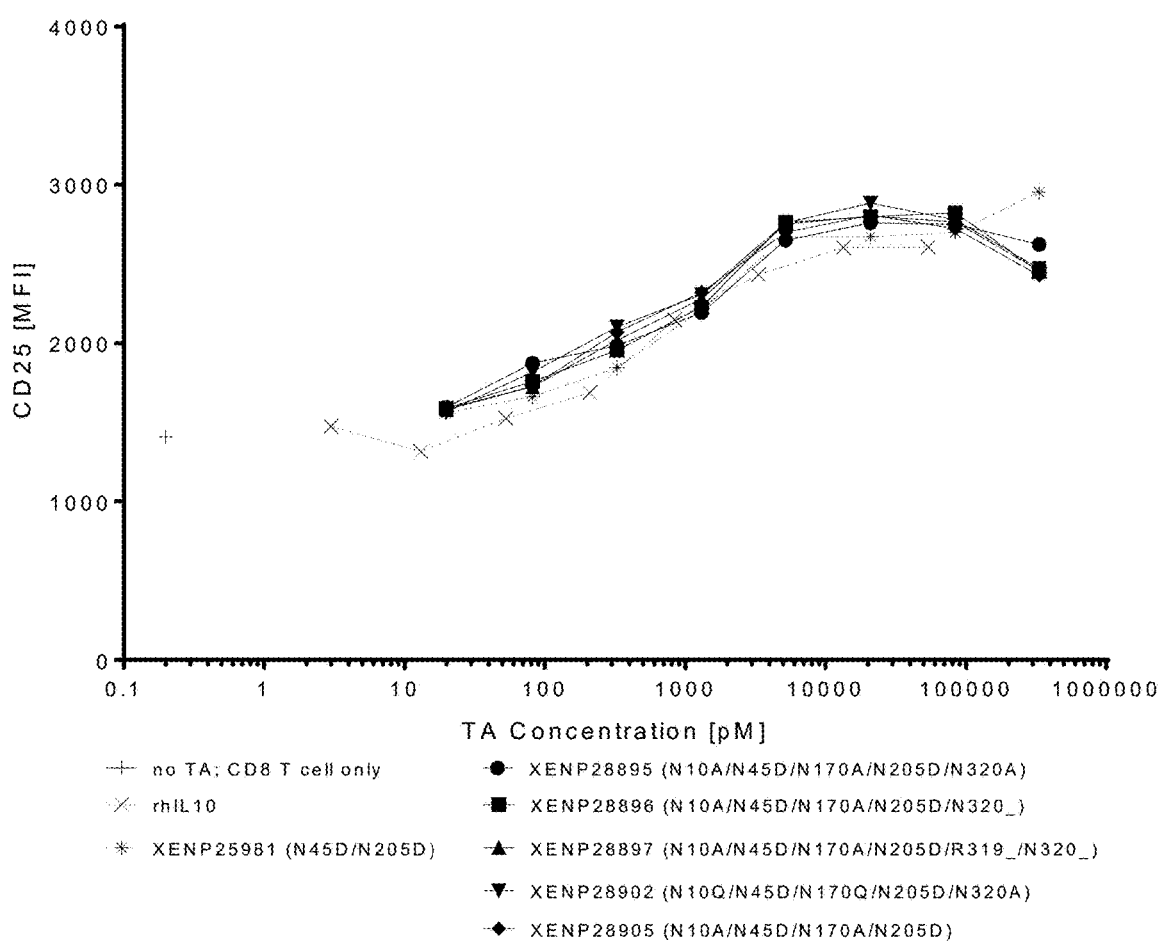
Figure 80A:
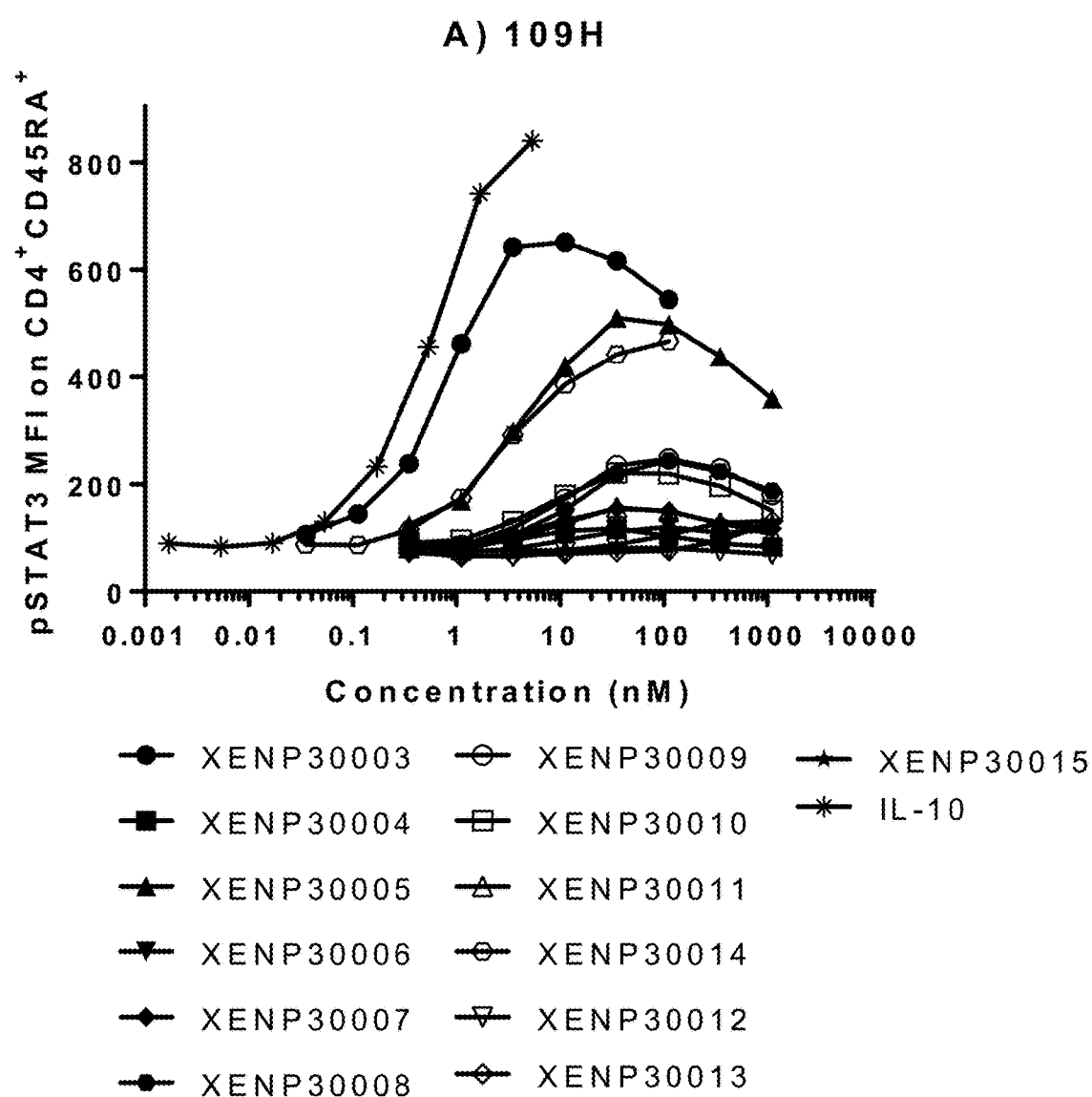
Figure 81A:
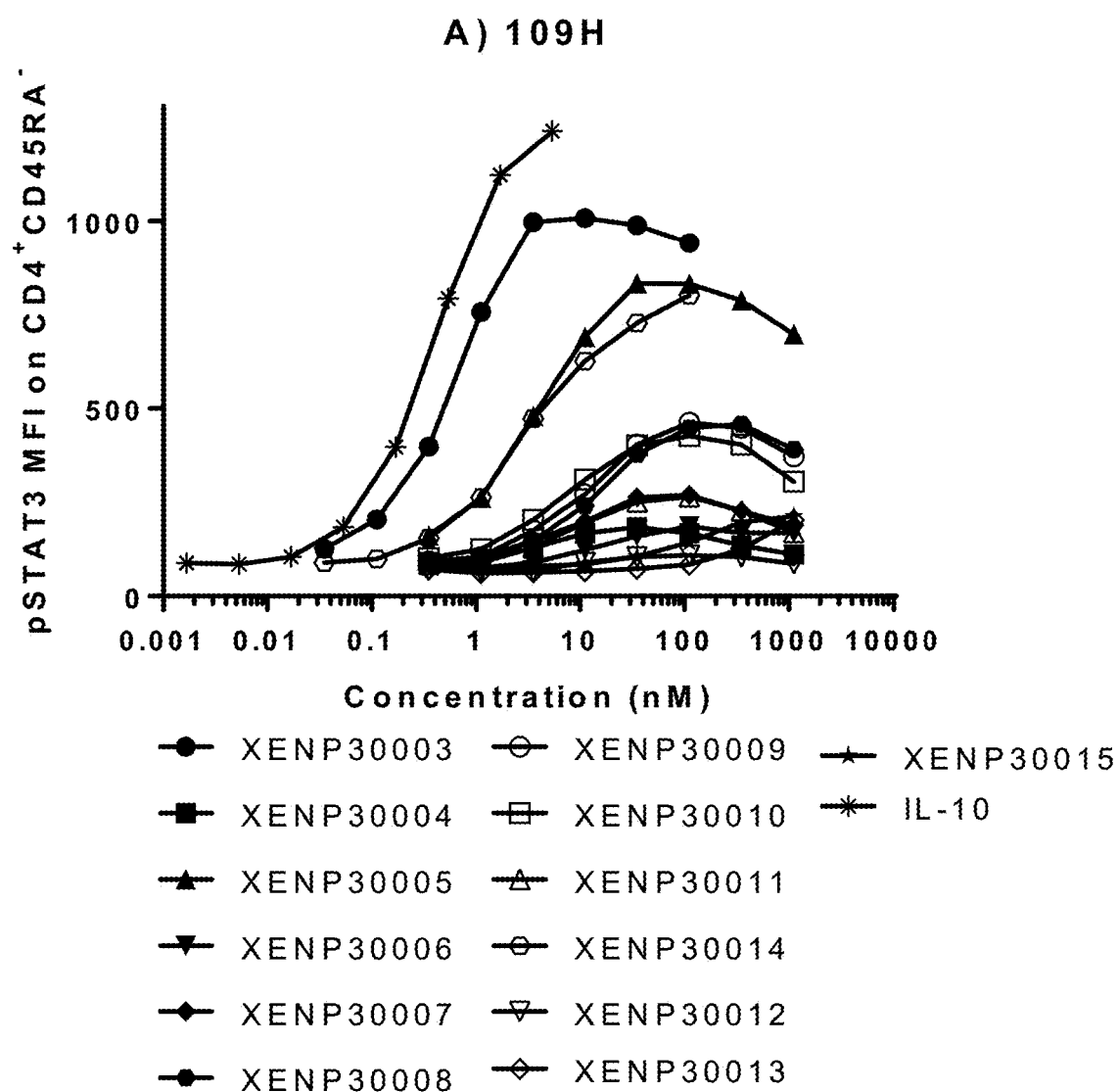
Figure 81B:
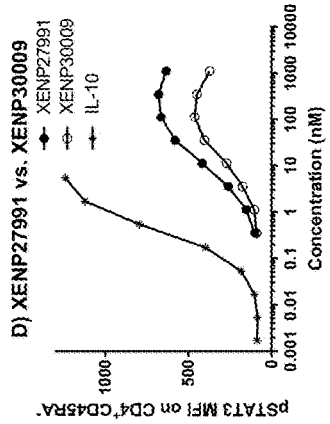
Figure 81C:
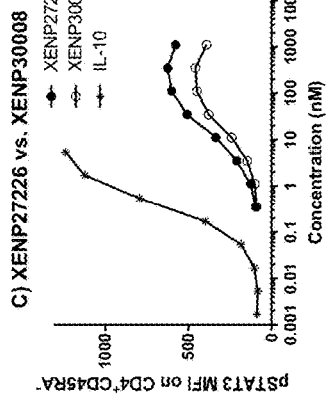
Figure 81D:
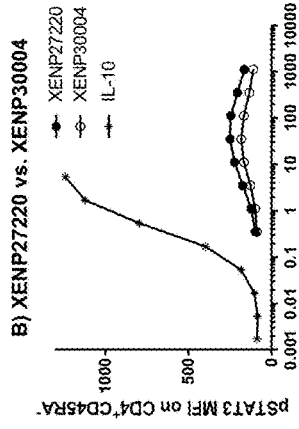
Figure 81E:
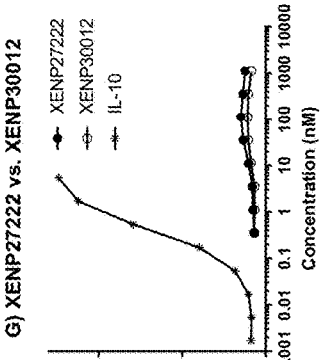
Figure 81F:
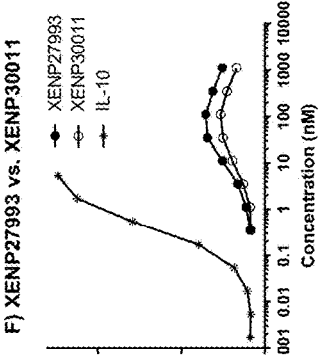
Figure 81G:
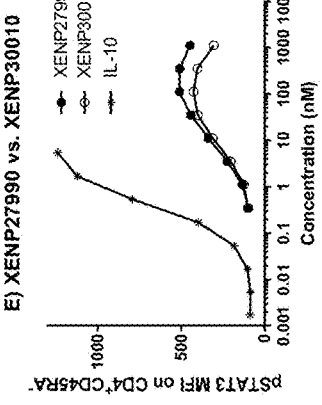
Figure 81H:
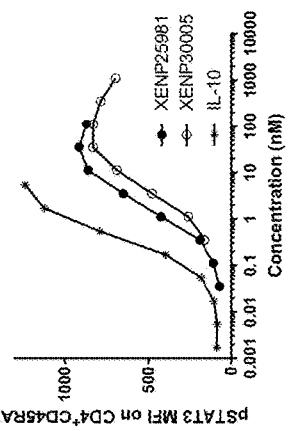
Figure 81I:
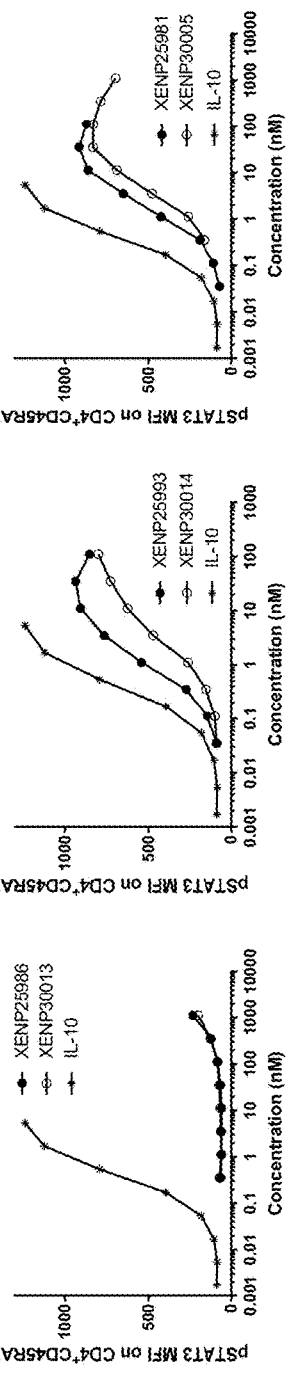
Figure 81J:
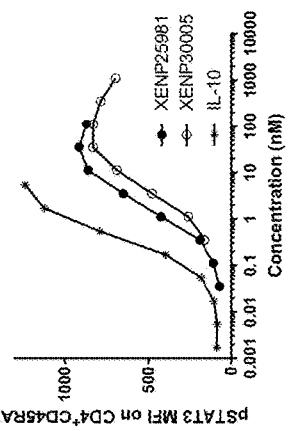
Figure 82A:
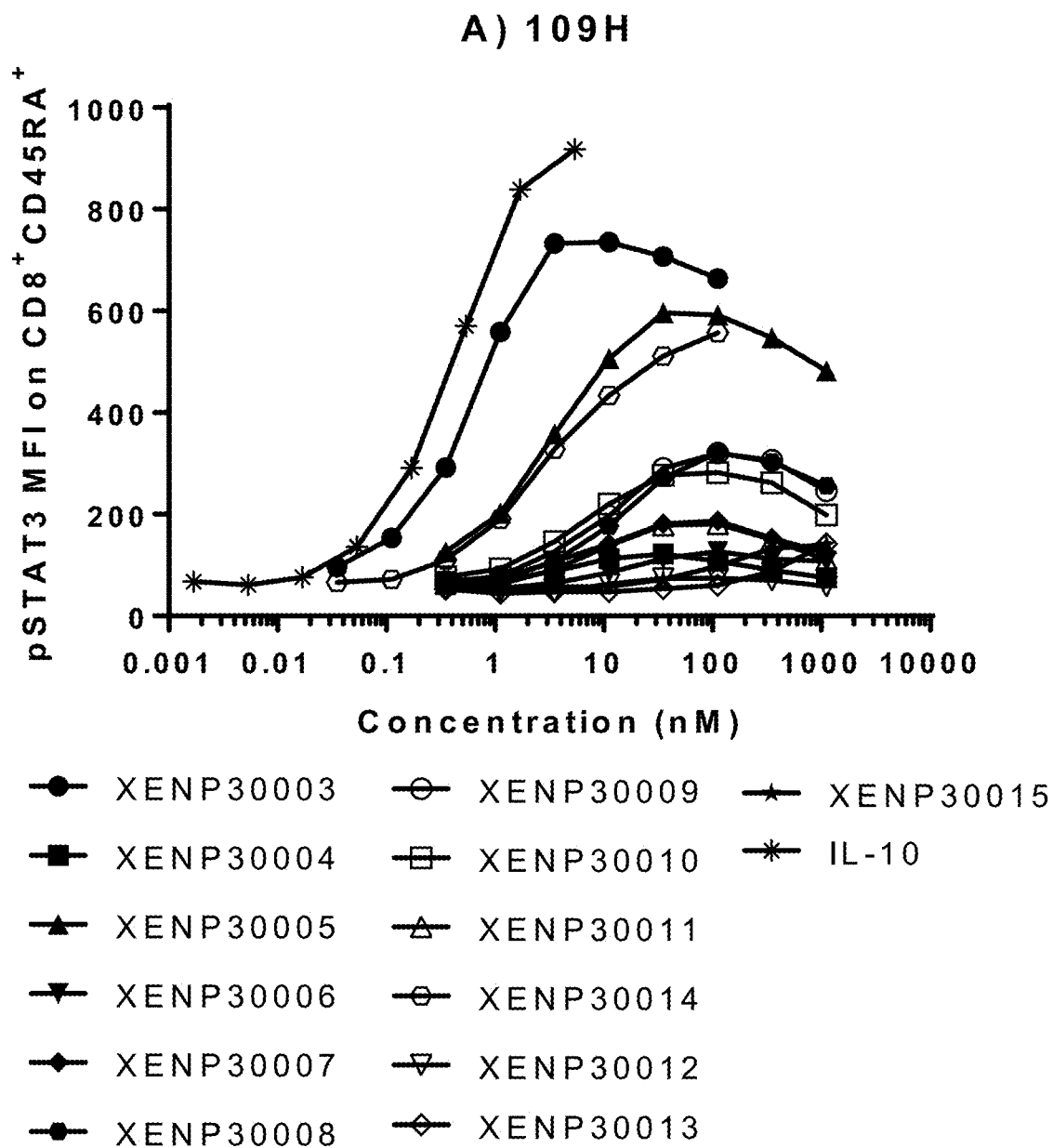
Figure 83A:
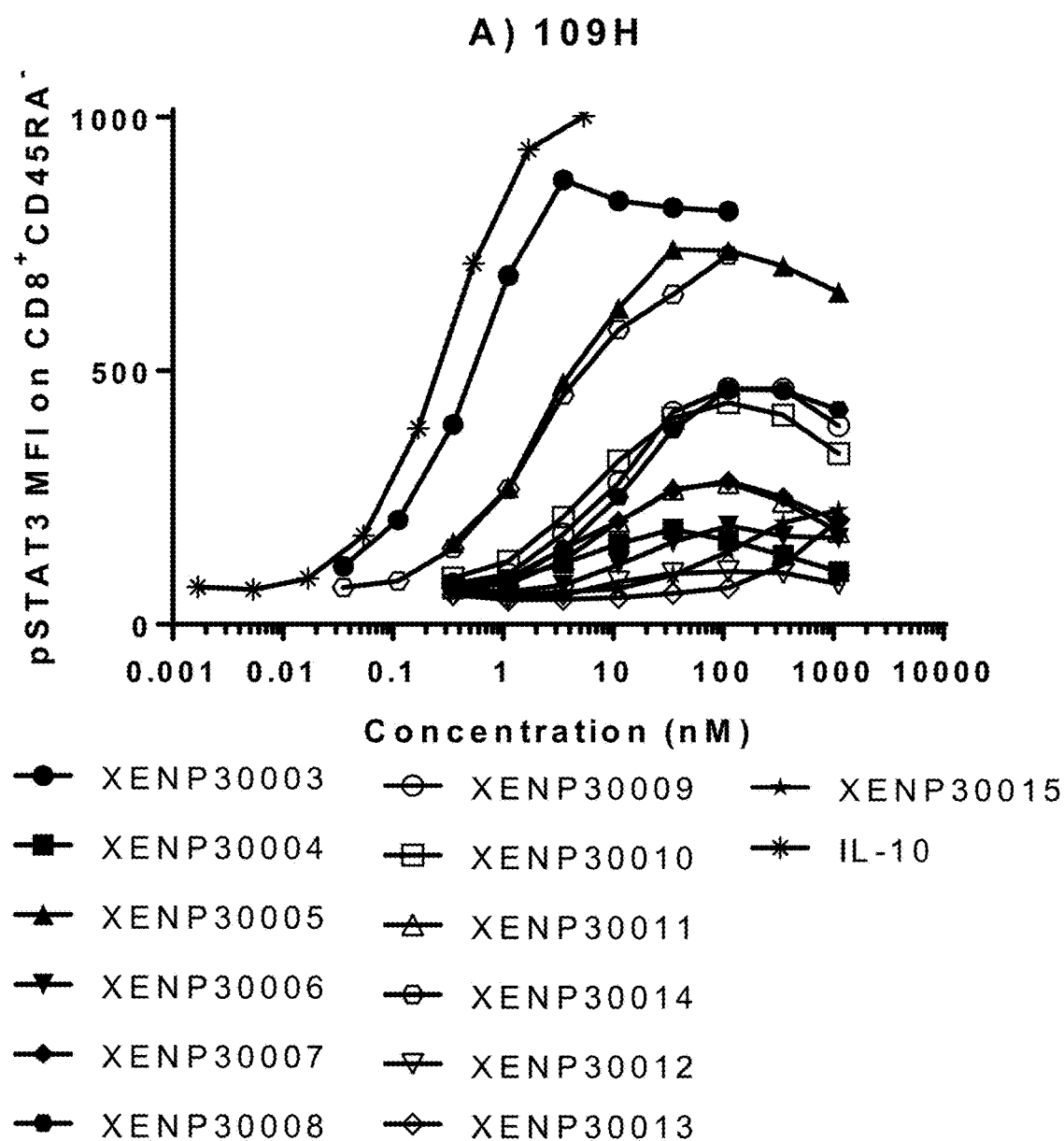
Figure 84A:
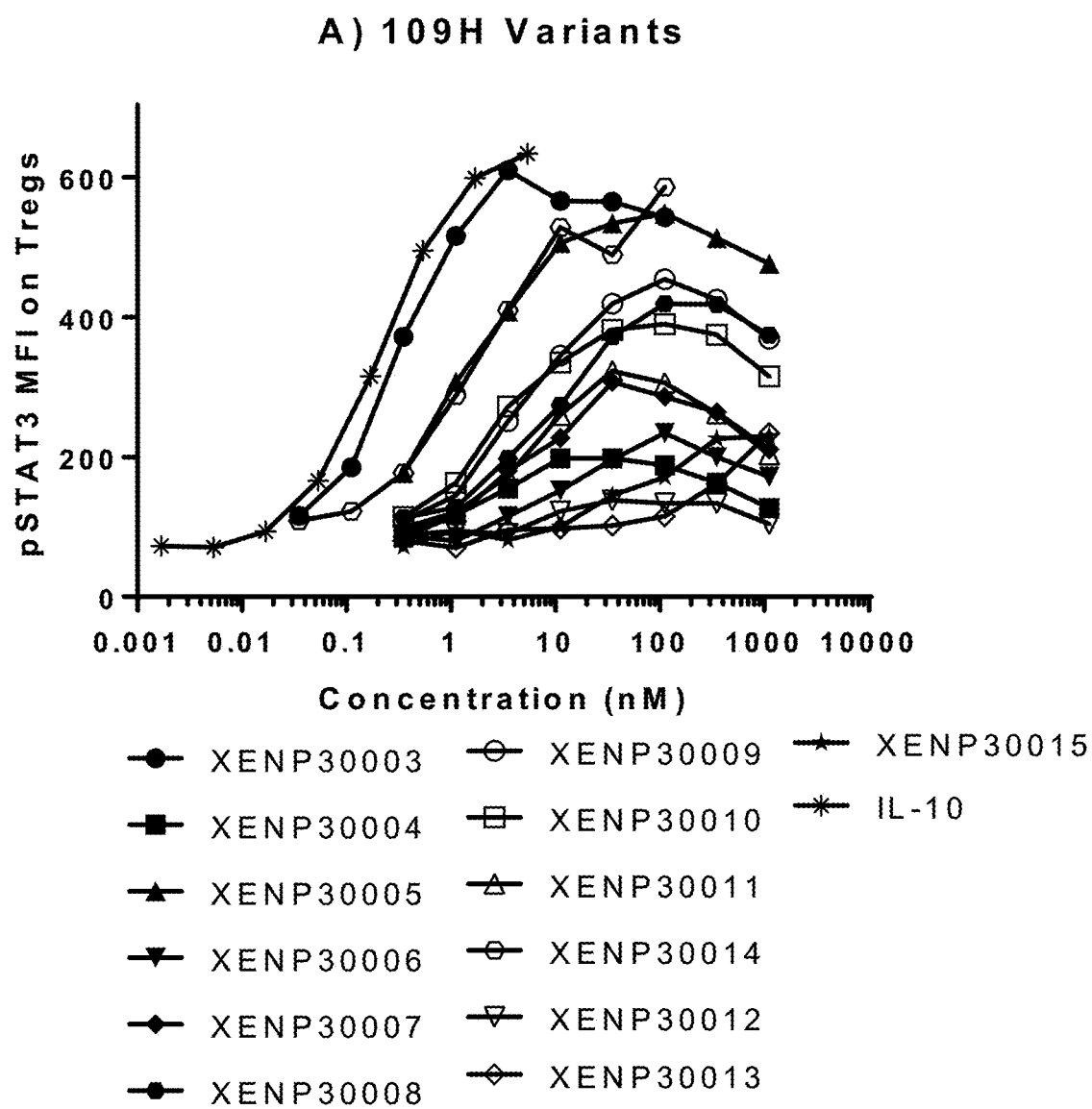
Figure 85A:
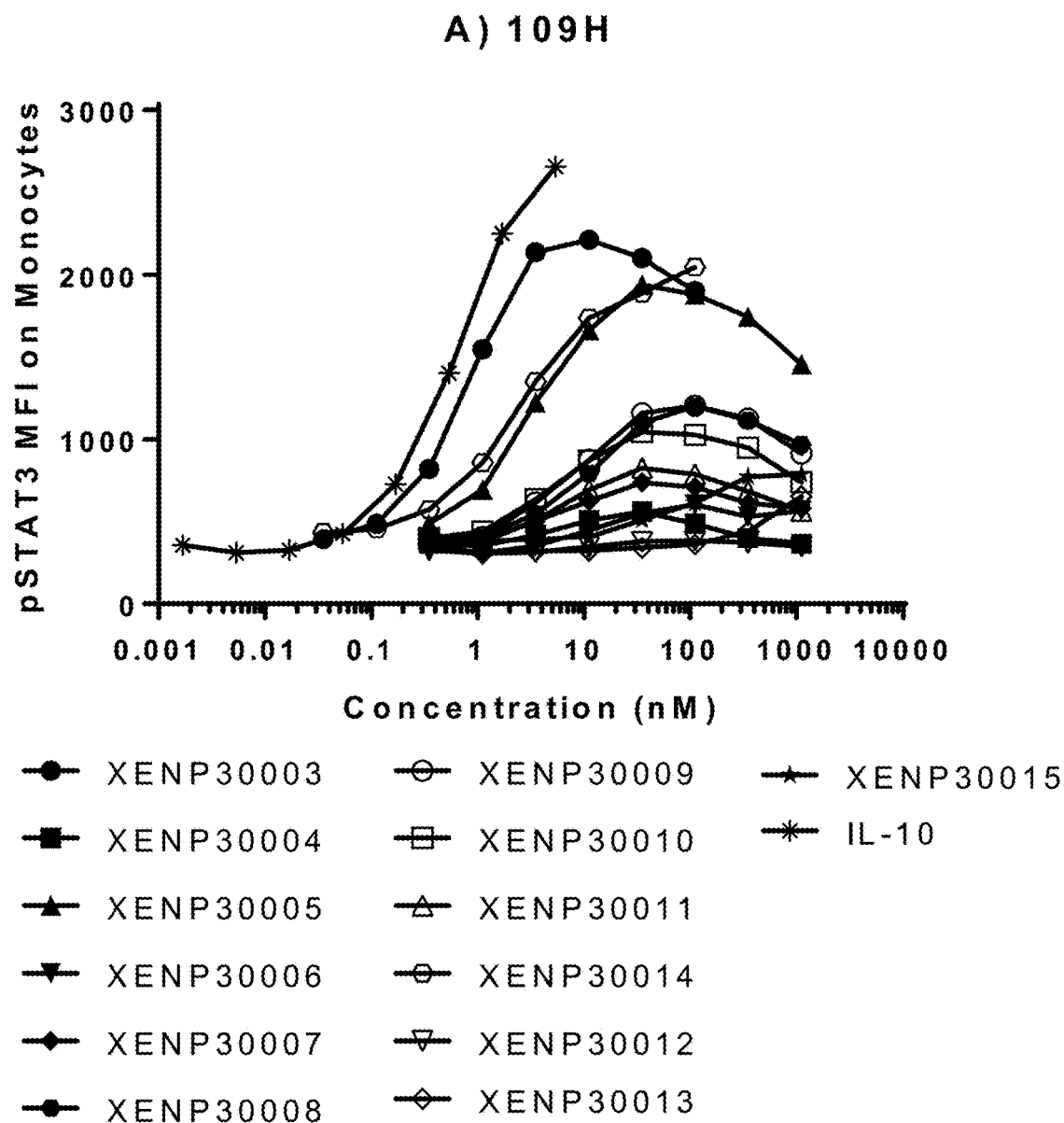

FIG. 63A-FIG. 63C the potentiation of A) IFNγ secretion, B) proliferation (as indicated by percentage cells expressing Ki67), and C) activation (as indicated by CD25 expression) of purified CD8+ T cells by scIL10-heteroFc fusions comprising scIL-10 variants engineered to remove potential degradation sites. The data shows that scIL-10 variants engineered to remove potential degradation sites did not lose their activity.

FIG. 64 depicts sequences for illustrative IL-10 monomer variants designed with the aim to remove potential N-glycosylation sites. It should be noted that these IL-10 variant sequences are based on the IL-10(109L) sequence, although they can be based on the IL-10(109H) sequence. Each of the substitutions herein can be used alone or in combination with any other substitutions depicted herein, including substitutions to modulate affinity/potency, introduce/remove disulfide bridges, improve yield, remove charge variants, remove glycosylation sites, and/or improve stability. Additionally, as will be clear to those skilled in the art, while the substitutions herein are depicted in the context of an IL-10 monomer, each of the substitutions can be used alone or in combination in the context of IL-10 domains (e.g. hIL-10 (A-D) and hIL-10(E-F)), scIL-10, and IL10M1.

FIG. 65A-FIG. 65B depict sequences for illustrative scIL-10 variants designed with the aim to remove potential N-glycosylation sites. It should be noted that these IL-10 variant sequences are based on the IL-10(109L) sequence, although they can also be based on the IL-10(109H) sequence. It should also be noted that while these IL-10 variant sequences include N45D substitution for improving yield, they can be used without N45D substitution. Each of the substitutions depicted in this Figure can be used alone or in combination with any other substitutions depicted herein, including substitutions to modulate affinity/potency, introduce/remove disulfide bridges, improve yield, remove charge variants, remove glycosylation sites, and/or improve stability. It should also be noted that these scIL-10 variants can optionally include a linker between each IL-10 sequence, although numbering of the substitutions would be based on the full-length scIL-10 sequence as depicted in FIG. 15C.

FIG. 66A-FIG. 66D depict the sequences illustrative IL-10 fusions of the scIL10-Fc category in the scIL10-heteroFc format comprising scIL-10 variants engineered with the aim to remove potential N-glycosylation sites. IL-10 sequences are underlined, linkers are double underlined (although as will be appreciated by those in the art, the linkers can be replaced by other linkers), and slashes (/) indicate the border(s) between IL-10 monomer, linkers, and Fc regions. It should be noted that while the IL-10 sequence depicted herein comprise 109L (and 269L, in the context of the scIL-10), the IL-10 fusion can utilize an IL-10 sequence comprising 109H (and 269H, in the context of the scIL-10), as well as IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 67 depicts sequences for illustrative IL-10 monomer variants designed with the aim to remove disulfide bridges. It should be noted that these IL-10 variant sequences are based on the IL-10(109L) sequence, although they can be based on the IL-10(109H) sequence. Each of the substitutions herein can be used alone or in combination with any other substitutions depicted herein, including substitutions to modulate affinity/potency, introduce/remove disulfide bridges, improve yield, remove charge variants, remove glycosylation sites, and/or improve stability. Additionally, as will be clear to those skilled in the art, while the substitutions herein are depicted in the context of an IL-10 monomer, each of the substitutions can be used alone or in combination in the context of IL-10 domains (e.g. hIL-10(A-D) and hIL-10(E-F)), scIL-10, and IL10M1.

FIG. 68 depicts sequences for illustrative scIL-10 variants designed with the aim to remove disulfide bridges. It should be noted that these IL-10 variant sequences are based on the IL-10(109L) sequence, although they can also be based on the IL-10(109H) sequence. It should also be noted that while these IL-10 variant sequences include N45D substitution for improving yield, they can be used without N45D substitution. It should further be noted that while these IL-10 variant sequences include N320A substitution to reduce potential for deamidation, they can be used without the N320A substitution. Each of the substitutions depicted in this Figure can be used alone or in combination with any other substitutions depicted herein, including substitutions to modulate affinity/potency, introduce/remove disulfide bridges, improve yield, remove charge variants, remove glycosylation sites, and/or improve stability. It should also be noted that these scIL-10 variants can optionally include a linker between each IL-10 sequence, although numbering of the substitutions would be based on the full-length scIL-10 sequence as depicted in FIG. 15C.

FIG. 69 depicts the sequences illustrative IL-10 fusions of the scIL10-Fc category in the scIL10-heteroFc format comprising scIL-10 variants engineered with the aim to remove disulfide bridges. IL-10 sequences are underlined, linkers are double underlined (although as will be appreciated by those in the art, the linkers can be replaced by other linkers), and slashes (/) indicate the border(s) between IL-10 monomer, linkers, and Fc regions. It should be noted that while the IL-10 sequence depicted herein comprise 109L (and 269L, in the context of the scIL-10), the IL-10 fusion can utilize an IL-10 sequence comprising 109H (and 269H, in the context of the scIL-10), as well as IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 70A-FIG. 70B depict sequences for illustrative IL10M1 variants designed with the aim to introduce additional disulfide bridge(s) or remove disulfide bridge(s). It should be noted that these IL-10 variant sequences are based on the IL-10(109H) sequence, although they can also be based on the IL-10(109L) sequence. Each of the substitutions depicted in this Figure can be used alone or in combination with any other substitutions depicted herein, including substitutions to modulate affinity/potency, introduce/remove disulfide bridges, improve yield, remove charge variants, remove glycosylation sites, and/or improve stability. Additionally, as will be clear to those skilled in the art, while the substitutions herein were designed in the context of an IL10M1, each of the substitutions may find use in the context of IL-10 monomers, IL-10 domains (e.g. hIL-10(A-D) and hIL-10(E-F)), and scIL-10.

FIG. 71A-FIG. 71E depict the sequences illustrative IL-10 fusions of the IL10M1-Fc category in the (IL10M1) 1-heteroFc format comprising IL10M1 variants designed with the aim to introduce additional disulfide bridge(s) or remove disulfide bridge(s). IL-10 sequences are underlined, linkers are double underlined (although as will be appreciated by those in the art, the linkers can be replaced by other linkers), and slashes (/) indicate the border(s) between IL-10 monomer, linkers, and Fc regions. It should be noted that while the IL-10 sequence depicted herein comprise 109H (and 269L, in the context of the scIL-10), the IL-10 fusion can utilize an IL-10 sequence comprising 109L (and 269H, in the context of the scIL-10), as well as IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 72A-FIG. 72AP depict the effect of in silico point mutations at IL10M1 core residues on its affinity for IL10M1 and its stability. WT indicates wild-type residue, pos indicates position in IL-10 (numbering according to the human IL-10 mature form sequence), and mut indicates substitution. The predictions depicted in this Figure provided the background for engineering IL10M1 variants having improved stability.

FIG. 73 depicts sequences for illustrative IL10M1 variants designed with the aim to improve stability. It should be noted that these IL-10 variant sequences are based on the IL-10(109H) sequence, although they can also be based on the IL-10(109L) sequence. Each of the substitutions depicted in this Figure can be used alone or in combination with any other substitutions depicted herein, including substitutions to modulate affinity/potency, introduce/remove disulfide bridges, improve yield, remove charge variants, remove glycosylation sites, and/or improve stability. Additionally, as will be clear to those skilled in the art, while the substitutions herein were designed in the context of an IL10M1, each of the substitutions may find use in the context of IL-10 monomers, IL-10 domains (e.g. hIL-10(A-D) and hIL-10(E-F)), and scIL-10.

FIG. 74A-FIG. 74B depict the sequences illustrative IL-10 fusions of the IL10M1-Fc category in the (IL10M1) $_1$-heteroFc format comprising IL10M1 variants engineered with the aim to improve stability. IL-10M1 sequences are underlined, linkers are double underlined (although as will be appreciated by those in the art, the linkers can be replaced by other linkers), and slashes (/) indicate the border(s) between IL10M1, linkers, and Fc regions. It should be noted that while the IL10M1 sequence depicted herein comprise 109H (numbered according to mature form IL-10 monomer without an internal linker), the IL-10 fusion can utilize an IL10M1 sequence comprising 109L, as well as IL10M1 sequences that are 90, 95, 98 and 99% identical (as defined herein), and/or contain from 1, 2, 3, 4, 5, 6, 7, 8, 9 or 10 additional amino acid substitutions.

FIG. 75A-FIG. 75B depict sequences for illustrative IL10M1 variants designed with alternative linkers between helices D and E with the aim to increase rigidity or to increase flexibility. It should be noted that these IL-10 variant sequences are based on the IL-10(109H) sequence, although they can be based on the IL-10(109L) sequence. Each of the IL10M1 sequences depicted in this Figure can include one or more substitutions depicted herein, including substitutions to modulate affinity/potency, introduce/remove disulfide bridges, improve yield, remove charge variants, remove glycosylation sites, and/or improve stability.

FIG. 76A-FIG. 76D depict the sequences illustrative IL-10 fusions of the IL10M1-Fc category in the (IL10M1) $_1$-heteroFc format comprising IL10M1 variants engineered with alternative linkers between helices D and E with the aim to increase rigidity or to increase flexibility. IL-10M1 sequences are underlined, linkers are double underlined (although as will be appreciated by those in the art, the linkers can be replaced by other linkers), and slashes (/) indicate the border(s) between IL10M1, linkers, and Fc regions. It should be noted that while the IL10M1 sequence depicted herein comprise 109H (numbered according to mature form IL-10 monomer without an internal linker), the IL-10 fusion can utilize an IL10M1 sequence comprising 109L, as well as IL10M1 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 77A-FIG. 77B depict sequences for preferred IL-10 variants engineered in the context of the IL-10(109H) sequence. Each of the substitutions depicted in this Figure can be used alone or in combination with any other substitutions depicted herein, including substitutions to modulate affinity/potency, introduce/remove disulfide bridges, improve yield, remove charge variants, remove glycosylation sites, and/or improve stability.

FIG. 78A-FIG. 78G depict illustrative sequences for IL-10 fusions of the scIL10-Fc category in the scIL10-heteroFc format comprising preferred IL-10 variants engineered in the context of the IL-10 IL-10(109H) sequence. IL-10 sequences are italicized, linkers are double underlined (although as will be appreciated by those in the art, the linkers can be replaced by other linkers), and slashes (/) indicate the border(s) between IL-10 components, linkers, and Fc regions. It should be noted that while the IL-10 sequence depicted herein comprise 109H (and 269H, in the context of the scIL-10), the IL-10 fusion can utilize an IL-10 sequence comprising 109L (and 269L, in the context of the scIL-10), as well as IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 79A-FIG. 79G depict illustrative sequences for IL-10 fusions of the scIL10-Fc category in the heteroFc-scIL10 format comprising preferred IL-10 variants engineered in the context of the IL-10 IL-10(109H) sequence. IL-10 sequences are italicized, linkers are double underlined (although as will be appreciated by those in the art, the linkers can be replaced by other linkers), and slashes (/) indicate the border(s) between IL-10 components, linkers, and Fc regions. It should be noted that while the IL-10 sequence depicted herein comprise 109H (and 269H, in the context of the scIL-10), the IL-10 fusion can utilize an IL-10 sequence comprising 109L (and 269L, in the context of the scIL-10), as well as IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 80A-FIG. 80J depict the induction of STAT3 phosphorylation on CD4$^+$CD45RA$^+$ T cells by A) illustrative IL-10 fusions based on 109H variants; B) XENP27220 vs. XENP30004; C) XENP27226 vs. XENP30008; D) XENP27991 vs. XENP30009; E) XENP27990 vs. XENP30010; F) XENP27993 vs. XENP30011; G) XENP27222 vs. XENP30012; H) XENP25986 vs. XENP30013; I) XENP25993 vs. XENP30014; and J) XENP25981 vs. XENP30005.

FIG. 81A-FIG. 81J depict the induction of STAT3 phosphorylation on CD4$^+$CD45RA$^-$ T cells by A) illustrative IL-10 fusions based on 109H variants; B) XENP27220 vs. XENP30004; C) XENP27226 vs. XENP30008; D) XENP27991 vs. XENP30009; E) XENP27990 vs. XENP30010; F) XENP27993 vs. XENP30011; G) XENP27222 vs. XENP30012; H) XENP25986 vs. XENP30013; I) XENP25993 vs. XENP30014; and J) XENP25981 vs. XENP30005.

FIG. 82A-FIG. 82J depict the induction of STAT3 phosphorylation on CD8$^+$CD45RA$^+$ T cells by A) illustrative IL-10 fusions based on 109H variants; B) XENP27220 vs. XENP30004; C) XENP27226 vs. XENP30008; D) XENP27991 vs. XENP30009; E) XENP27990 vs. XENP30010; F) XENP27993 vs. XENP30011; G) XENP27222 vs. XENP30012; H) XENP25986 vs. XENP30013; I) XENP25993 vs. XENP30014; and J) XENP25981 vs. XENP30005.

FIG. 83A-FIG. 83J depict the induction of STAT3 phosphorylation on CD8$^+$CD45RA$^-$ T cells by A) illustrative IL-10 fusions based on 109H variants; B) XENP27220 vs. XENP30004; C) XENP27226 vs. XENP30008; D) XENP27991 vs. XENP30009; E) XENP27990 vs. XENP30010; F) XENP27993 vs. XENP30011; G) XENP27222 vs. XENP30012; H) XENP25986 vs. XENP30013; I) XENP25993 vs. XENP30014; and J) XENP25981 vs. XENP30005.

FIG. 84A-FIG. 84J depict the induction of STAT3 phosphorylation on Tregs by A) illustrative IL-10 fusions based on 109H variants; B) XENP27220 vs. XENP30004; C) XENP27226 vs. XENP30008; D) XENP27991 vs. XENP30009; E) XENP27990 vs. XENP30010; F) XENP27993 vs. XENP30011; G) XENP27222 vs. XENP30012; H) XENP25986 vs. XENP30013; I) XENP25993 vs. XENP30014; and J) XENP25981 vs. XENP30005.

FIG. 85A-FIG. 85J depicts the induction of STAT3 phosphorylation on monocytes by A) illustrative IL-10 fusions based on 109H variants; B) XENP27220 vs. XENP30004; C) XENP27226 vs. XENP30008; D) XENP27991 vs. XENP30009; E) XENP27990 vs. XENP30010; F) XENP27993 vs. XENP30011; G) XENP27222 vs. XENP30012; H) XENP25986 vs. XENP30013; I) XENP25993 vs. XENP30014; and J) XENP25981 vs. XENP30005.

FIG. 86A-FIG. 86D depict the sequences for illustrative IL-10 fusion proteins engineered with Xtend Fc (M428L/N434S). IL-10 sequences are underlined, linkers are double underlined (although as will be appreciated by those in the art, the linkers can be replaced by other linkers), and slashes (/) indicate the border(s) between IL-10 monomer, linkers, and Fc regions. It should be noted that while the IL-10 sequence depicted herein comprise 109L (and 269L, in the context of the scIL-10), the IL-10 fusion can utilize an IL-10 sequence comprising 109H (and 269H, in the context of the scIL-10), as well as IL-10 sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 87A-FIG. 87D depicts illustrative formats for targeted IL-10 fusions based on the IL10-Fc category, herein referred to as the "targeted IL10-Fc" category. The "mAb-IL10" format (FIG. 87A) comprises two identical monomers, each monomer comprising an antigen-binding domain covalently linked to the N-terminus of a homodimeric Fc chain which is covalently linked via the C-terminus, optionally via a linker, to an IL-10 monomer. The "IL10-mAb" format (FIG. 87B) comprises two identical monomers, each monomer comprising an IL-10 monomer covalently linked, optionally via a linker, to an antigen-binding domain which is covalently linked to the N-terminus of a homodimeric Fc chain. The "mAb-central-IL10" format (FIG. 87C) comprises two identical monomers, each monomer comprising an antigen-binding domain covalently linked to an IL-10 monomer which is covalently linked, optionally via a linker, to a homodimeric Fc chain. It should be noted that while the antigen-binding domains are depicted as Fabs, the antigen-binding domain can be any antigen binding molecule as defined herein, such as an scFv. The "anti-X×IL10-heteroFc" format (FIG. 87D) comprises a first monomer comprising an antigen-binding domain covalently linked to the N-terminus of a first heterodimeric Fc chain and a second monomer comprising a first IL-10 monomer covalently attached to the N-terminus of a second heterodimeric Fc chain (optionally via a domain linker), and a second IL-10 monomer transfected separately so that it forms a non-covalent interaction with the first IL-10 monomer.

FIG. 88A-FIG. 88E depict illustrative formats for targeted IL-10 fusions based on the scIL10-Fc category, herein referred to as the "targeted scIL10-Fc" category. The "anti-X×scIL10-heteroFc" format (FIG. 88A) comprises a first monomer comprising an antigen-binding domain covalently linked to the N-terminus of a first heterodimeric Fc chain and a second monomer comprising a scIL-10 covalently attached to the N-terminus of a second heterodimeric Fc chain (optionally via a domain linker). In one aspect, the "anti-Xx heteroFc-scIL10" format (FIG. 88B) comprises a first monomer comprising an antigen-binding domain covalently linked to the N-terminus of a first heterodimeric Fc chain and a second monomer comprising a second heterodimeric Fc chain covalently linked via the C-terminus to a scIL-10 (optionally via a domain linker). In another aspect, the "anti-X× heteroFc-scIL10" format comprises a first monomer comprising an antigen-binding domain covalently linked to the N-terminus of a first heterodimeric Fc chain which is covalently linked via the C-terminus to a scIL-10 (optionally via a domain linker), and a second monomer comprising a complementary second heterodimeric Fc chain that is "Fc-only" or "empty-Fc". The "(anti-X)2-heteroFc-scIL10" format (FIG. 88C) comprises a first monomer comprising an antigen-binding domain covalently linked to the N-terminus of a first heterodimeric Fc chain and a second monomer comprising an antigen-binding domain covalently linked to the N-terminus of a second heterodimeric Fc chain which is covalently linked via the C-terminus to a scIL-10 (optionally via a domain linker). The "(anti-X)2-central-scIL10" format (FIG. 88D) comprises a first monomer comprising an antigen-binding domain covalently linked to the N-terminus of a first heterodimeric Fc chain and a second monomer comprising an antigen-binding domain covalently linked to a scIL-10 which is covalently linked to the N-terminus of a second heterodimeric Fc chain (optionally via a linker). The "scIL10-(anti-X)2-heteroFc" format (FIG. 88E) comprises a first monomer comprising an antigen-binding domain covalently linked to the N-terminus of a first heterodimeric Fc chain and a second monomer comprising a scIL-10 covalently linked, optionally via a linker, to an antigen-binding domain which is covalently linked to the N-terminus of a second heterodimeric Fc chain (optionally via a linker). It should be noted that while the antigen-binding domains are depicted as Fabs, the antigen-binding domain can be any antigen binding molecule as defined herein, such as an scFv.

Figures 89A, 89B, 89C, 89D:
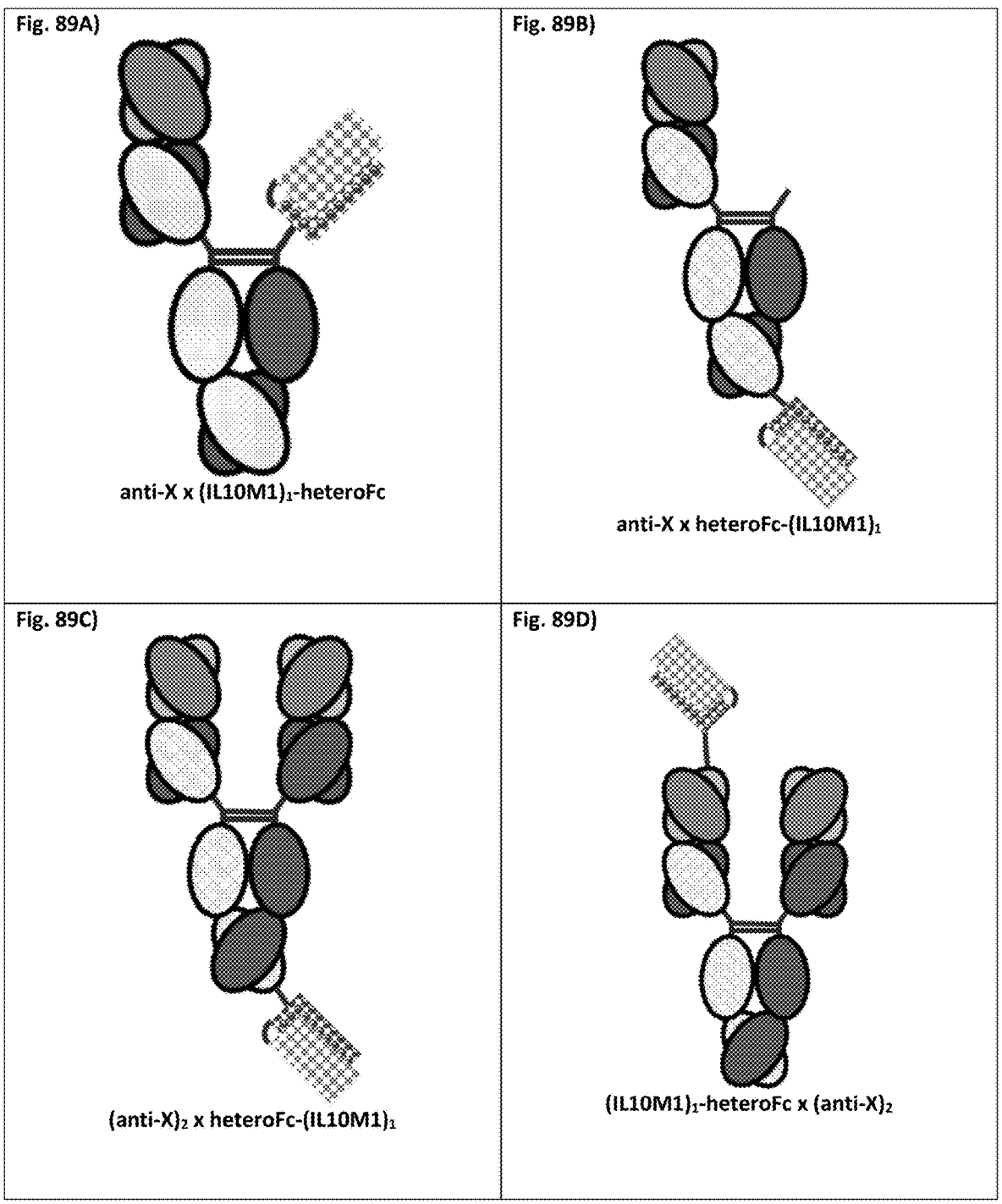
Figures 89E, 89F, 89G, 89H:
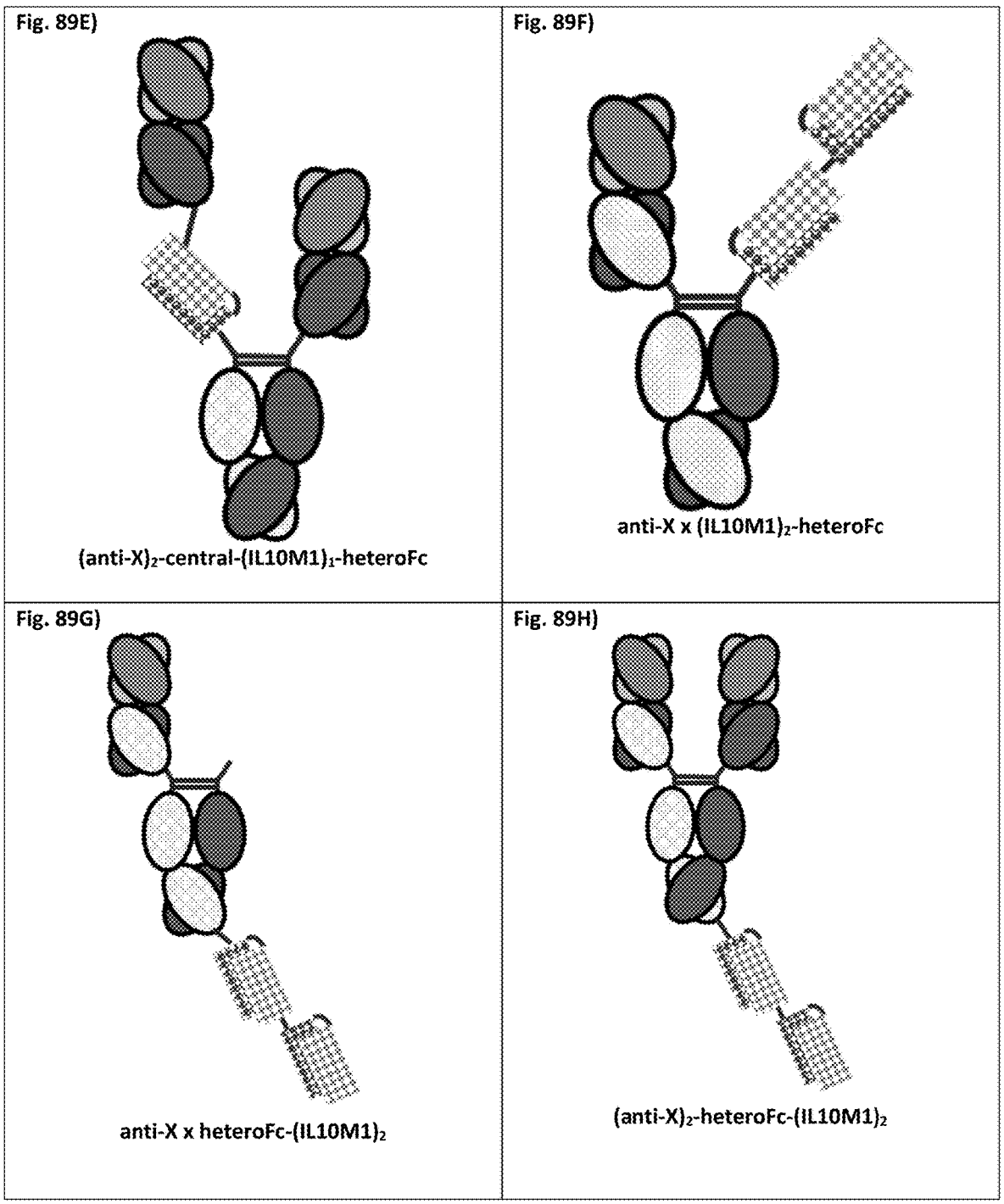
Figures 89I, 89J, 89K, 89L:
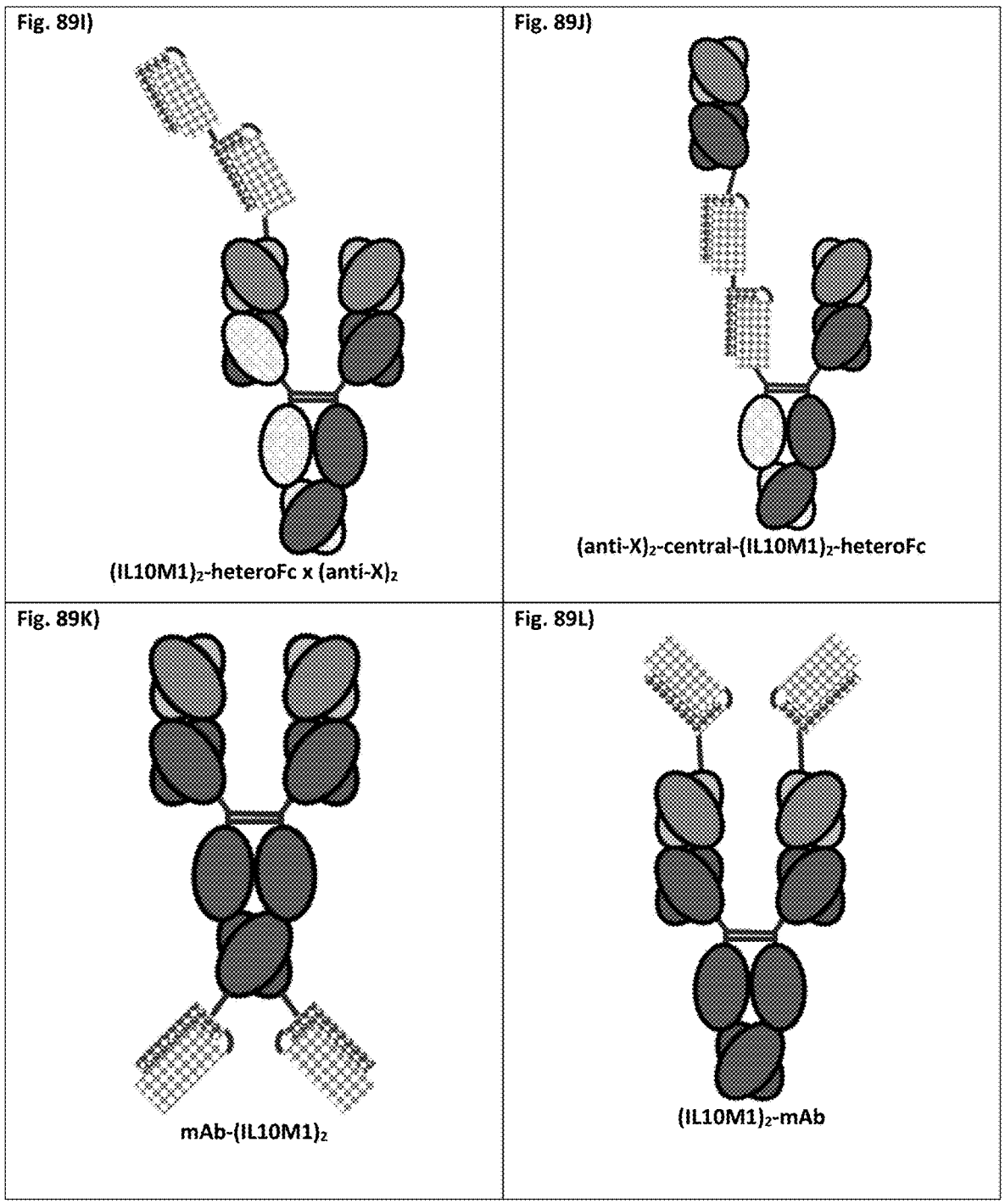
Figure 89M:
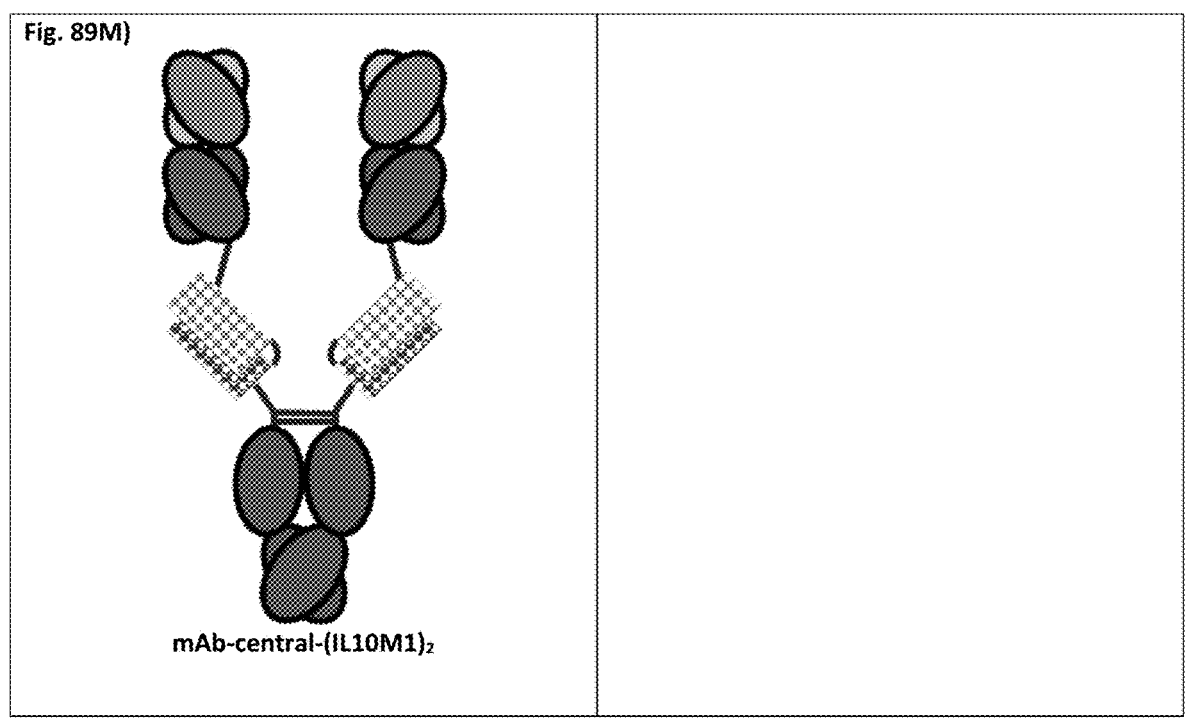
Figures 90A, 90B, 90C, 90D:
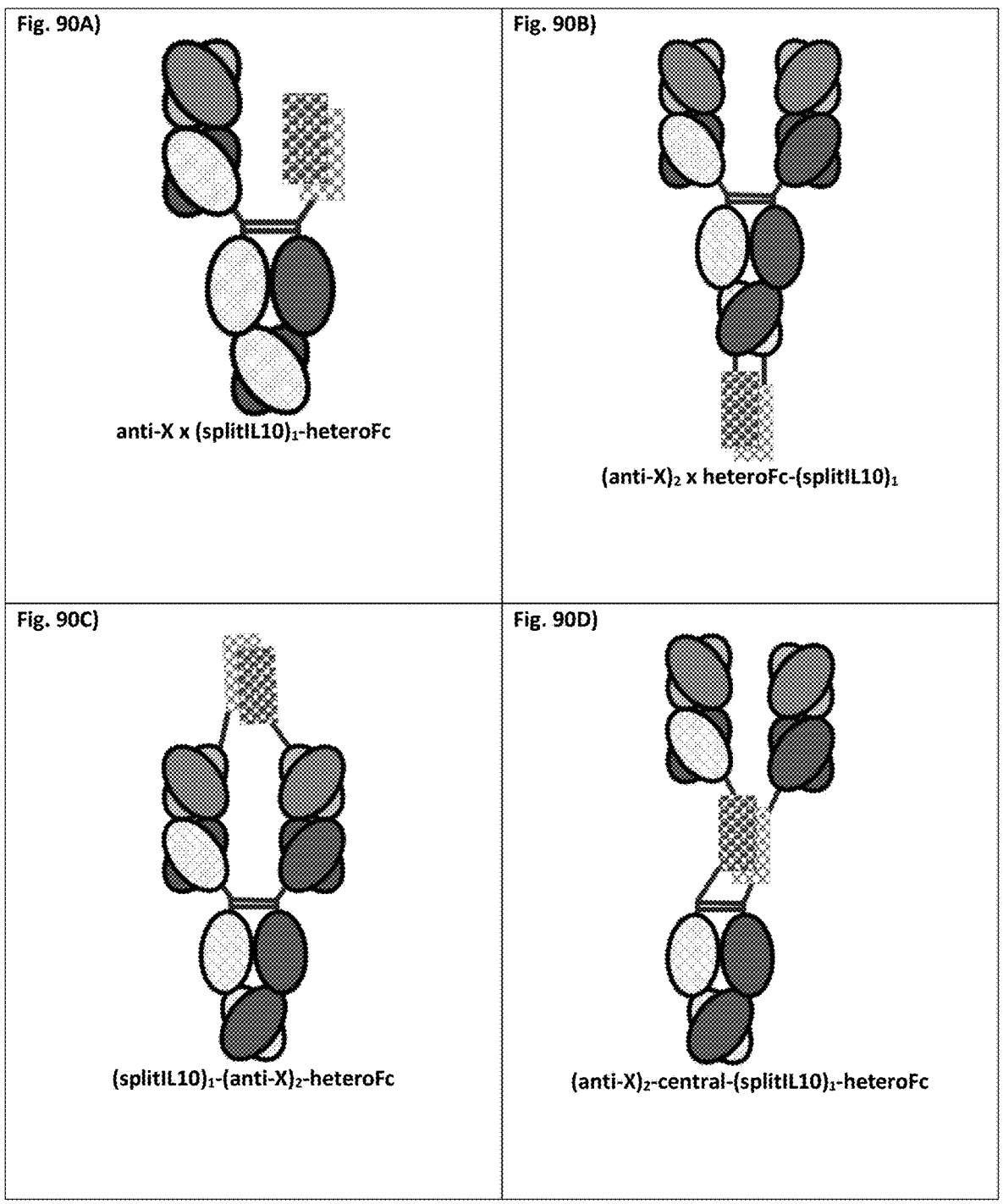
Figures 90E, 90F, 90G, 90H:
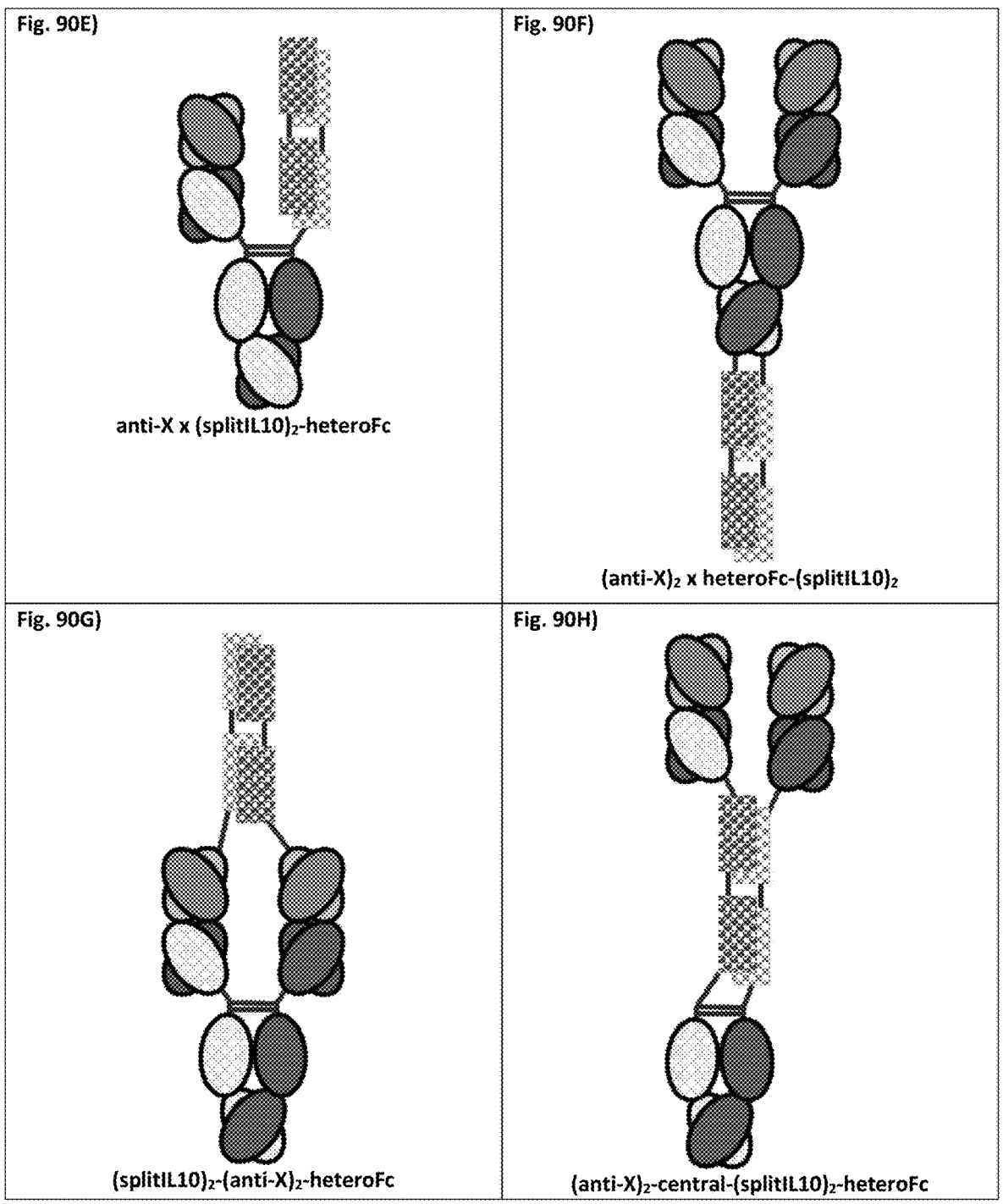
Figure 99A:
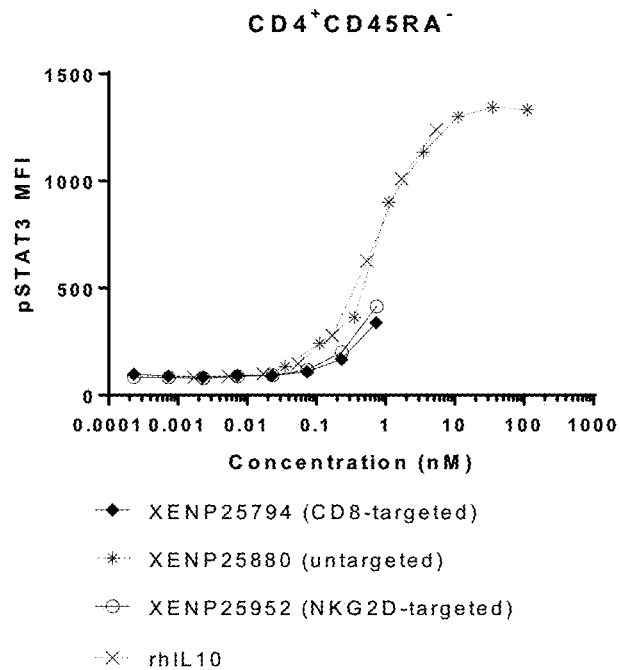
Figure 99B:
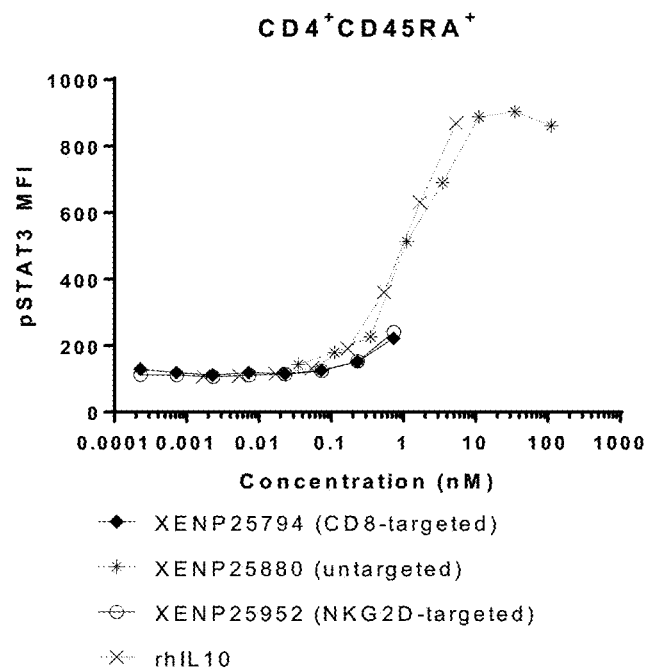
Figure 99C:
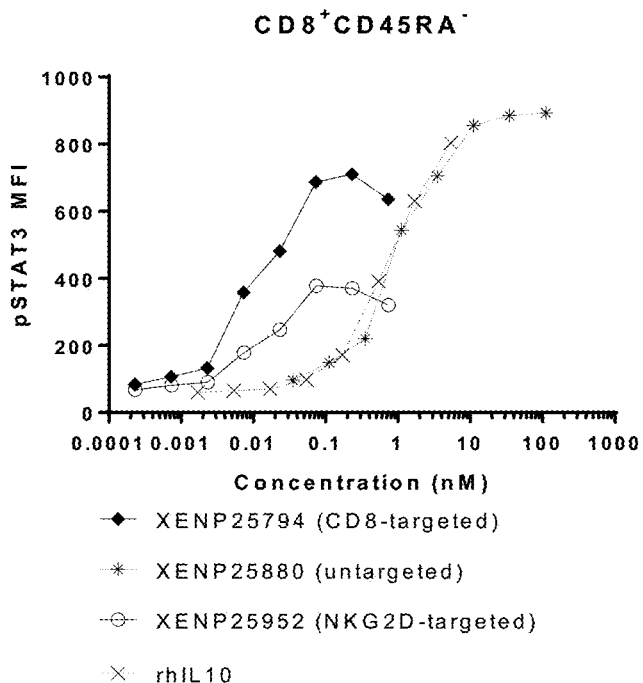
Figure 99D:
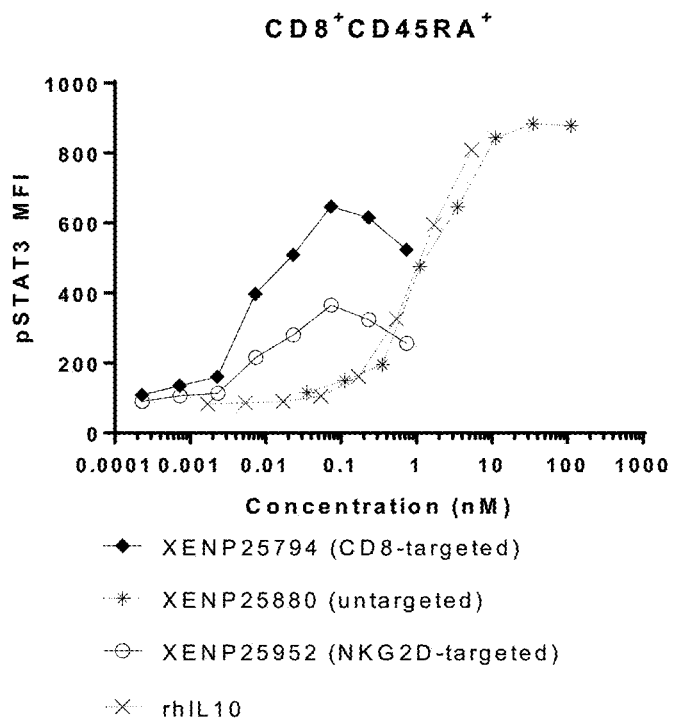
Figure 99E:
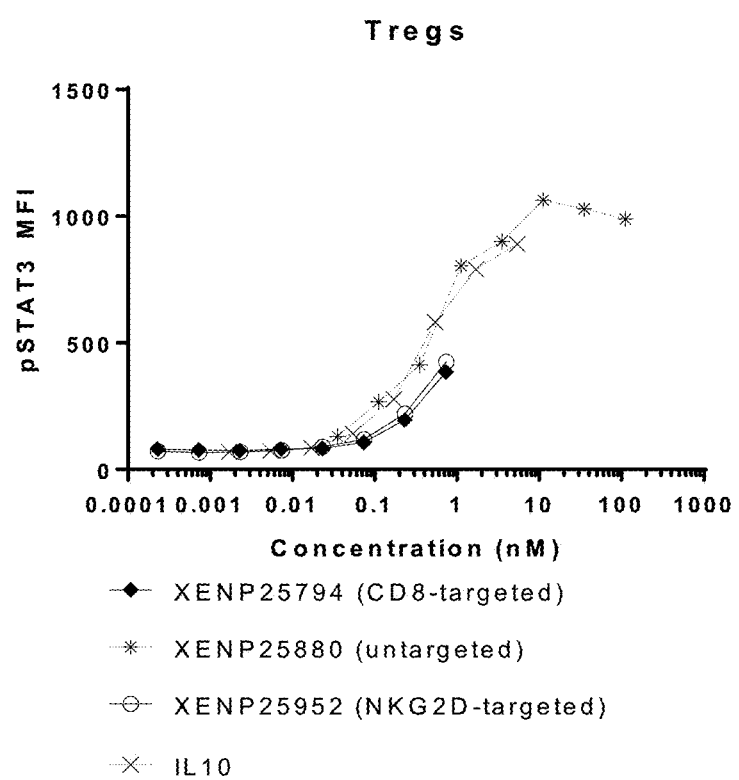
Figure 107A:
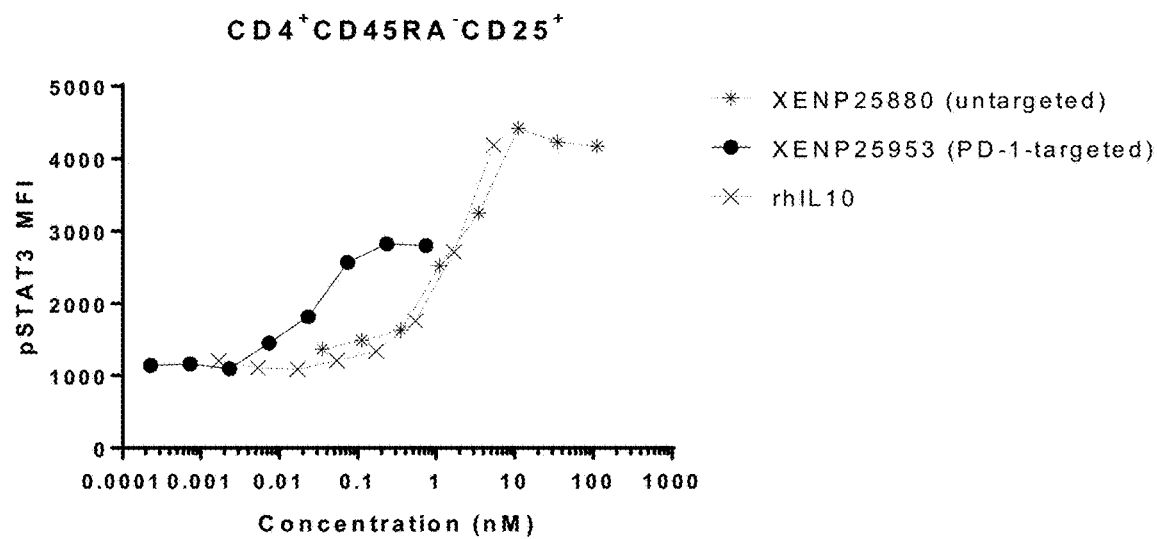
Figure 107B:
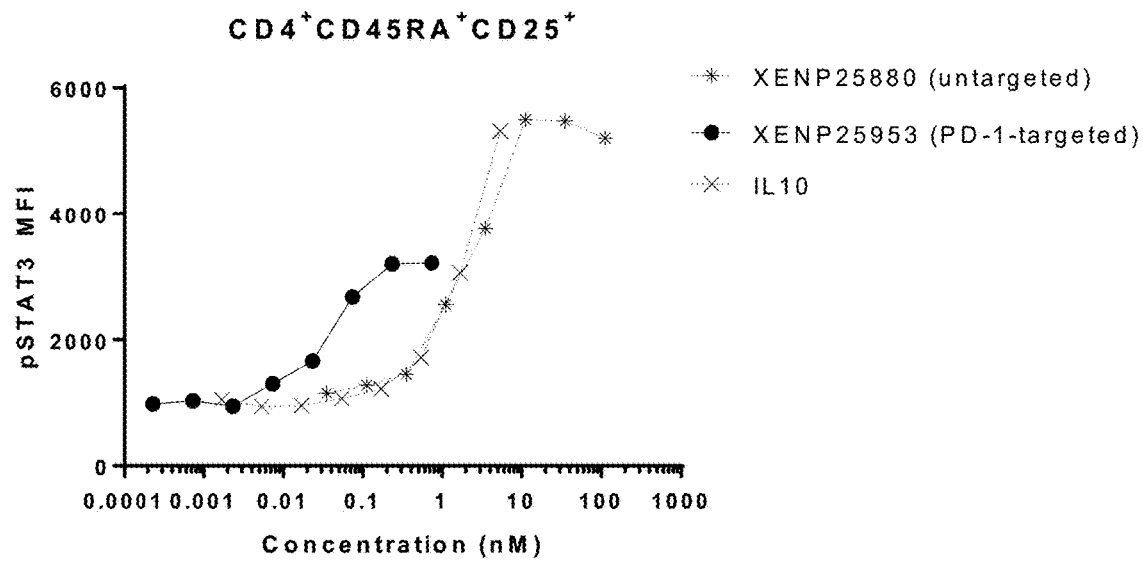
Figure 107C:
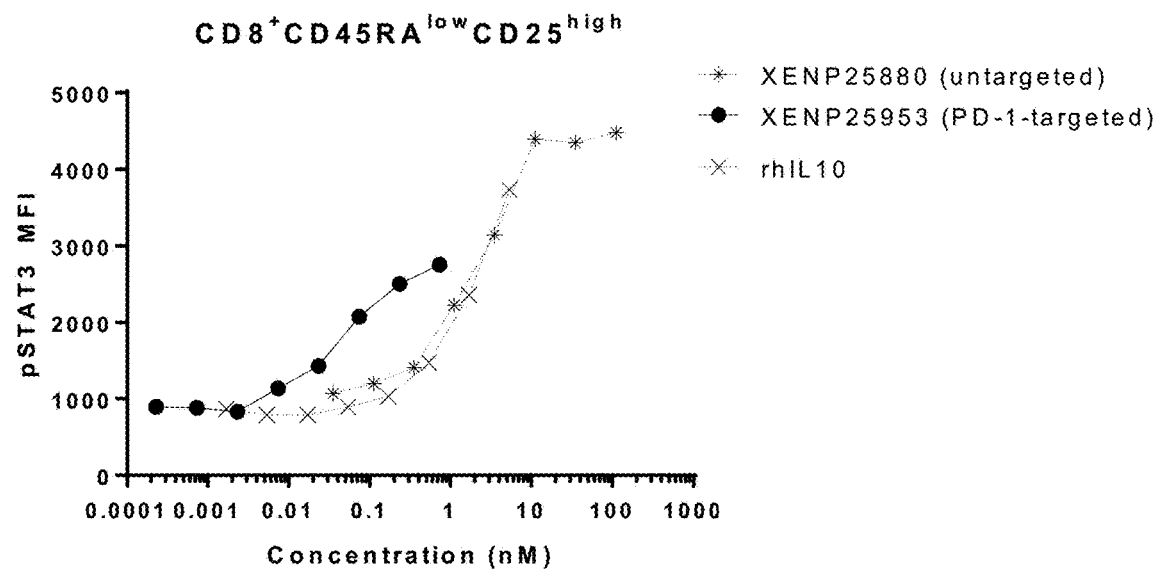
Figure 107D:
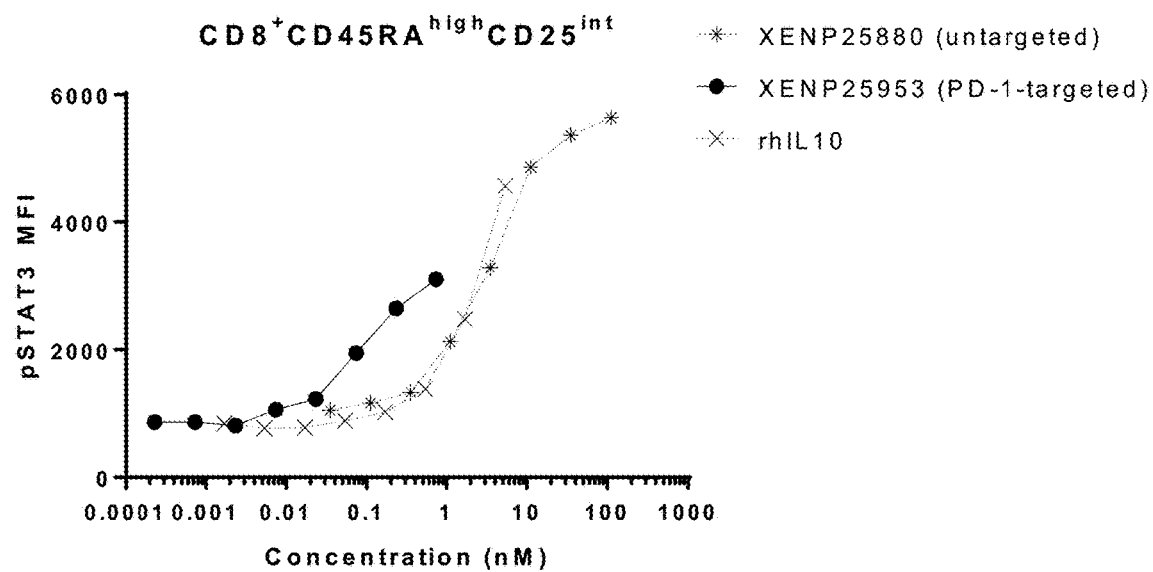
Figure 107E:
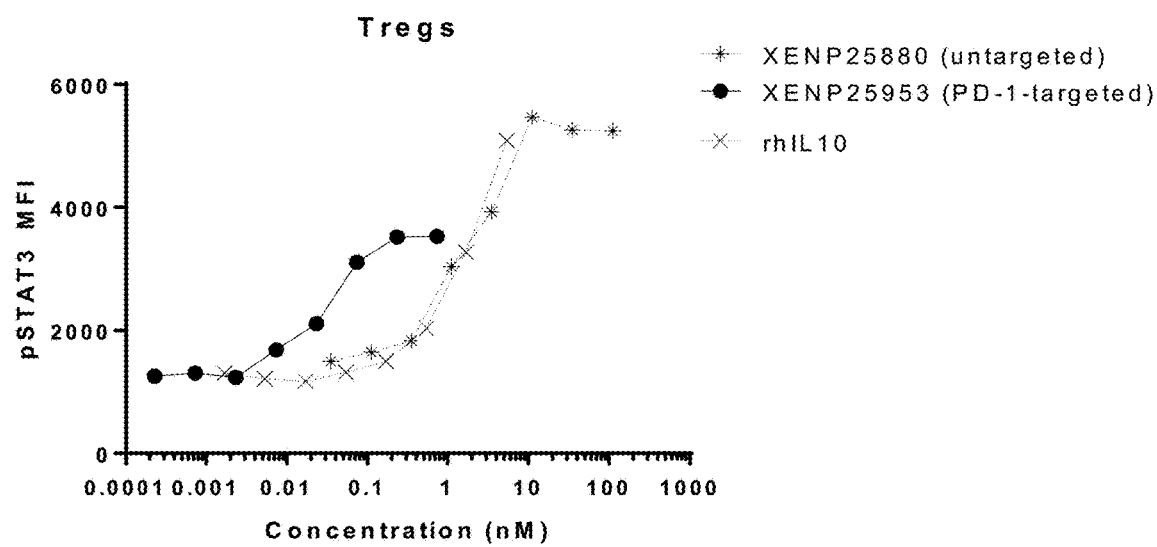

FIG. 89A-FIG. 89M depict illustrative formats for targeted IL-10 fusions based on the IL10M1-Fc category, herein referred to as the "targeted IL10M1-Fc" category. The "anti-X×(IL10M1)$_1$-heteroFc" format (FIG. 89A) comprises a first monomer comprising an antigen-binding domain covalently linked to the N-terminus of a first heterodimeric Fc chain and a second monomer comprising an IL10M1 covalently attached to the N-terminus of a second heterodimeric Fc chain (optionally via a domain linker). In one aspect, the "anti-X× heteroFc-(IL10M1)$_1$" format (FIG. 89B) comprises a first monomer comprising an antigen-binding domain covalently linked to the N-terminus of a first heterodimeric Fc chain and a second monomer comprising a second heterodimeric Fc chain covalently linked via the C-terminus to an IL10M1 (optionally via a domain linker). In another aspect, the "anti-X× heteroFc-(IL10M1)$_1$" format comprises a first monomer comprising an antigen-binding domain covalently linked to the N-terminus of a first heterodimeric Fc chain which is covalently linked via the C-terminus to an IL10M1 (optionally via a domain linker), and a second monomer comprising a complementary second heterodimeric Fc chain that is "Fc-only" or "empty-Fc". The "(anti-X)2-heteroFc-(IL10M1)$_1$" format (FIG. 89C) comprises a first monomer comprising an antigen-binding domain covalently linked to the N-terminus of a first heterodimeric Fc chain and a second monomer comprising an antigen-binding domain covalently linked to the N-terminus of a second heterodimeric Fc chain which is covalently linked via the C-terminus to an IL10M1 (optionally via a domain linker). The "(IL10M1)1-(anti-X)2-heteroFc" format (FIG. 89D) comprises a first monomer comprising an antigen-binding domain covalently linked to the N-terminus of a first heterodimeric Fc chain and a second monomer comprising an IL10M1 covalently linked, optionally via a linker, to an antigen-binding domain which is covalently linked to the N-terminus of a second heterodimeric Fc chain (optionally via a linker). The "(anti-X)2-central-(IL10M1)1" format (FIG. 89E) comprises a first monomer comprising an antigen-binding domain covalently linked to the N-terminus of a first heterodimeric Fc chain and a second monomer comprising an antigen-binding domain covalently linked to an IL10M1 which is covalently linked to the N-terminus of a second heterodimeric Fc chain (optionally via a linker). The "anti-X×(IL10M1)$_2$-heteroFc" format (FIG. 89F) comprises a first monomer comprising an antigen-binding domain covalently linked to the N-terminus of a first heterodimeric Fc chain and a second monomer comprising a first IL10M1 covalently attached, optionally via a domain linker, to a second IL10M1 which is covalently attached to the N-terminus of a second heterodimeric Fc chain (optionally via a domain linker). In one aspect, the "anti-X× heteroFc-(IL10M1)$_2$" format (FIG. 89G) comprises a first monomer comprising an antigen-binding domain covalently linked to the N-terminus of a first heterodimeric Fc chain and a second monomer comprising a second heterodimeric Fc chain covalently linked via the C-terminus to a first IL10M1 (optionally via a domain linker) which is covalently attached, optionally via a domain linker, to a second IL10M1. In another aspect, the "anti-X× heteroFc-(IL10M1)$_2$" format comprises a first monomer comprising an antigen-binding domain covalently linked to the N-terminus of a first heterodimeric Fc chain which is covalently linked via the C-terminus to a first IL10M1 (optionally via a domain linker) which is covalently linked, optionally via a domain linker, to a second IL10M1, and a second monomer comprising a complementary second heterodimeric Fc chain that is "Fc-only" or "empty-Fc". The "(anti-X)$_2$-heteroFc-(IL10M1)$_2$" format (FIG. 89H) comprises a first monomer comprising an antigen-binding domain covalently linked to the N-terminus of a first heterodimeric Fc chain and a second monomer comprising an antigen-binding domain covalently linked to the N-terminus of a second heterodimeric Fc chain which is covalently linked via the C-terminus to a first IL10M1 (optionally via a domain linker) which is covalently attached, optionally via a domain linker, to a second IL10M1. The "(IL10M1)$_2$-(anti-X)$_2$-heteroFc" format (FIG. 89I) comprises a first monomer comprising an antigen-binding domain covalently linked to the N-terminus of a first heterodimeric Fc chain and a second monomer comprising a first IL10M1 covalently linked, optionally via a linker, to a second IL10M1 which is covalently attached (optionally via a domain linker) to an antigen-binding domain which is covalently linked to the N-terminus of a second heterodimeric Fc chain (optionally via a linker). The "(anti-X)$_2$-central-(IL10M1)$_2$" format (FIG. 89J) comprises a first monomer comprising an antigen-binding domain covalently linked to the N-terminus of a first heterodimeric Fc chain and a second monomer comprising an antigen-binding domain covalently linked to a first IL10M1 which is covalently linked, optionally via a domain linker, to a second IL10M1 which is covalently attached to the N-terminus of a second heterodimeric Fc chain (optionally via a linker). The "mAb-(IL10M1)$_2$" format (FIG. 89K) comprises two identical monomers, each monomer comprising an antigen-binding domain covalently linked to the N-terminus of a homodimeric Fc chain which is covalently linked via the C-terminus, optionally via a linker, to an IL10M1. The "(IL10M1)$_2$-mAb" format (FIG. 89L) comprises two identical monomers, each monomer comprising an IL10M1 covalently linked, optionally via a linker, to an antigen-binding domain which is covalently linked to the N-terminus of a homodimeric Fc chain. The "mAb-central-$(IL10M1)_2$" format (FIG. 89M) comprises two identical monomers, each monomer comprising an antigen-binding domain covalently linked to an IL10M1 which is covalently linked, optionally via a linker, to a homodimeric Fc chain. It should be noted that while the antigen-binding domains are depicted as Fabs, the antigen-binding domain can be any antigen binding molecule as defined herein, such as an scFv.

FIG. 90A-90H depicts illustrative formats for targeted IL-10 fusions based on the splitIL10-Fc category, herein referred to as the "targeted splitIL10-Fc" category. In one aspect, the "anti-X×$(splitIL10)_1$-heteroFc" format (FIG. 90A) comprises a first monomer comprising an antigen-binding domain covalently linked to the N-terminus of a first heterodimeric Fc chain and a second monomer comprising a hIL-10(A-D) domain covalently attached to the N-terminus of a second heterodimeric Fc chain (optionally via a domain linker), and a hIL-10(E-F) domain transfected separately so that it non-covalently interacts with the hIL-10(A-D) domain. In another aspect, the "anti-X×$(splitIL10)_1$-heteroFc" format comprises a first monomer comprising an antigen-binding domain covalently linked to the N-terminus of a first heterodimeric Fc chain and a second monomer comprising a hIL-10(E-F) domain covalently attached to the N-terminus of a second heterodimeric Fc chain (optionally via a domain linker), and a hIL-10(A-D) domain transfected separately so that it non-covalently interacts with the hIL-10(E-F) domain. The "$(anti-X)_2$× heteroFc-$(splitIL10)_1$" format (FIG. 90B) comprises a first monomer comprising an antigen-binding domain covalently attached to the N-terminus of a first heterodimeric Fc chain which is covalently linked via the C-terminus to a hIL-10(A-D) domain and a second monomer comprising an antigen-binding domain covalently linked to the N-terminus of a second heterodimeric Fc chain covalently linked via the C-terminus to a hIL-10(E-F) domain. The "$(splitIL10)_1$-$(anti-X)_2$-heteroFc" format (FIG. 90C) comprises a first monomer comprising an hIL-10(A-D) domain covalently attached to an antigen-binding domain which is covalently attached to the N-terminus of a first heterodimeric Fc chain and a second monomer comprising an hIL-10(E-F) domain covalently attached to an antigen-binding domain which is covalently attached to the N-terminus of a second heterodimeric Fc chain. The "$(anti-X)_2$-central-$(splitIL10)_1$-heteroFc" format (FIG. 90D) comprises a first monomer comprising an antigen-binding domain covalently attached to a hIL-10(A-D) domain which is covalently attached to a first heterodimeric Fc chain and a second monomer comprising an antigen-binding domain covalently attached to a hIL-10(E-F) domain which is covalently attached to a second heterodimeric Fc chain. In one aspect, the "anti-X×$(splitIL10)_2$-heteroFc" format (FIG. 90E) comprises a first monomer comprising an antigen-binding domain covalently linked to the N-terminus of a first heterodimeric Fc chain and a second monomer comprising a first hIL-10(A-D) domain covalently attached to a second hIL-10(A-D) domain which is covalently attached to the N-terminus of a second heterodimeric Fc chain (optionally via a domain linker), and a first hIL-10(E-F) domain covalently attached to a second hIL-10(E-F) domain transfected separately so that they non-covalently interacts with the hIL-10(A-D) domains. In another aspect, the "anti-X×(splitIL10)2-heteroFc" format comprises a first monomer comprising an antigen-binding domain covalently linked to the N-terminus of a first heterodimeric Fc chain and a second monomer comprising a first hIL-10(E-F) domain covalently attached to a second hIL-10(E-F) domain which is covalently attached to the N-terminus of a second heterodimeric Fc chain (optionally via a domain linker), and a first hIL-10(A-D) domain covalently attached to a second hIL-10(A-D) domain transfected separately so that they non-covalently interact with the hIL-10(E-F) domains. The "$(anti-X)_2$× heteroFc-$(splitIL10)_2$" format (FIG. 90F) comprises a first monomer comprising an antigen-binding domain covalently attached to the N-terminus of a first heterodimeric Fc chain which is covalently linked via the C-terminus to a first hIL-10(A-D) domain covalently attached to a second hIL-10(A-D) domain and a second monomer comprising an antigen-binding domain covalently linked to the N-terminus of a second heterodimeric Fc chain covalently linked via the C-terminus to a first hIL-10(E-F) domain covalently attached to a second hIL-10(E-F) domain. The "(splitIL10)2-$(anti-X)_2$-heteroFc" format (FIG. 90G) comprises a first monomer comprising a first hIL-10 (A-D) domain covalently attached to a second hIL-10(A-D) domain which is covalently attached to an antigen-binding domain which is covalently attached to the N-terminus of a first heterodimeric Fc chain and a second monomer comprising a first hIL-10(E-F) domain covalently attached to a second hIL-10(E-F) domain which is covalently attached to an antigen-binding domain which is covalently attached to the N-terminus of a second heterodimeric Fc chain. The "$(anti-X)_2$-central-$(splitIL10)_2$-heteroFc" format (FIG. 90H) comprises a first monomer comprising an antigen-binding domain covalently attached to a first hIL-10(A-D) domain which is covalently attached to a second hIL-10(A-D) domain which is covalently attached to a first heterodimeric Fc chain and a second monomer comprising an antigen-binding domain covalently attached to a first hIL-10(E-F) domain which is covalently attached to a second hIL-10(E-F) domain which is covalently attached to a second heterodimeric Fc chain.

FIG. 91A-FIG. 91B depict sequences for control RSV-targeted IL-10 fusions. IL-10 components are italicized, linkers are double underlined (although as will be appreciated by those in the art, the linkers can be replaced by other linkers), and slashes (/) indicate the border(s) between the IL-10 components, variable regions, and constant/Fc regions. The CDRs are underlined. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the RSV-targeted IL-10 fusion proteins of the invention.

FIG. 92 depicts $V_H$ and $V_L$ domain sequences for an illustrative humanized anti-CD8 antibodies. The CDRs are underlined. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the CD8-targeted IL-10 fusion proteins of the invention.

FIG. 93A-FIG. 93C depict $V_H$ and $V_L$ domain sequences for an illustrative anti-NKG2D antibody. The CDRs are underlined. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the NKG2D-targeted IL-10 fusion proteins of the invention.

FIG. 94 depicts sequences for illustrative CD8-targeted IL-10 fusions in the "anti-Xx(IL10M1)$_1$-heteroFc" format. IL-10 components are italicized, linkers are double underlined (although as will be appreciated by those in the art, the linkers can be replaced by other linkers), and slashes (/) indicate the border(s) between the IL-10 components, variable regions, and constant/Fc regions. The CDRs are underlined. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the CD8-targeted IL-10 fusion proteins of the invention.

FIG. 95 depicts sequences for illustrative CD8-targeted IL-10 fusions in the "mAb-(IL10M1)$_2$" format. IL-10 components are italicized, linkers are double underlined (although as will be appreciated by those in the art, the linkers can be replaced by other linkers), and slashes (/) indicate the border(s) between the IL-10 components, variable regions, and constant/Fc regions. The CDRs are underlined. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the CD8-targeted IL-10 fusion proteins of the invention.

FIG. 96A-FIG. 96C depict sequences for illustrative CD8-targeted IL-10 fusions in the "anti-XxscIL10-heteroFc" format. IL-10 components are italicized, linkers are double underlined (although as will be appreciated by those in the art, the linkers can be replaced by other linkers), and slashes (/) indicate the border(s) between the IL-10 components, variable regions, and constant/Fc regions. The CDRs are underlined. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the CD8-targeted IL-10 fusion proteins of the invention. It should be noted that while the IL-10 sequence depicted herein comprise 109L, the sequences can also comprise 109H, as well as sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 97A-FIG. 97C depict sequences for illustrative NKG2D-targeted IL-10 fusions in the "anti-XxscIL10-heteroFc" format. IL-10 components are italicized, linkers are double underlined (although as will be appreciated by those in the art, the linkers can be replaced by other linkers), and slashes (/) indicate the border(s) between the IL-10 components, variable regions, and constant/Fc regions. The CDRs are underlined. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the NKG2D-targeted IL-10 fusion proteins of the invention. It should be noted that while the IL-10 sequence depicted herein comprise 109L, the sequences can also comprise 109H, as well as sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 98 depicts sequences for an illustrative CD8-targeted IL-10 fusion in the "anti-XxscIL10-heteroFc" format comprising an illustrative IL-10 potency variant. IL-10 components are italicized, linkers are double underlined (although as will be appreciated by those in the art, the linkers can be replaced by other linkers), and slashes (/) indicate the border(s) between the IL-10 components, variable regions, and constant/Fc regions. The CDRs are underlined. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the CD8-targeted IL-10 fusion proteins of the invention. It should be noted that while the IL-10 sequence depicted herein comprise 109L, the sequences can also comprise 109H, as well as sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 99A-FIG. 99E depict the induction of STAT3 phosphorylation by CD8- and NKG2D-targeted IL-10 fusions on A) CD4$^+$CD45RA$^-$ T cells, B) CD4$^+$CD45RA$^+$ T cells, C) CD8$^+$CD45RA$^-$ T cells, D) CD8$^+$CD45RA$^+$ T cells, and E) Tregs. The data show that CD8-targeted IL-10 fusion XENP25794 induced STAT3 phosphorylation on CD8$^+$ T cells much more potently than the non-targeted IL-10 fusion (XENP25880). In addition, the NKG2D-targeted IL-10 fusion (XENP25952) also showed a selectivity for CD8$^+$ T cells over CD4$^+$ T cells.

FIG. 100A-FIG. 100G depict $V_H$ and $V_L$ domain sequences for an illustrative humanized anti-PD-1 antibody. The CDRs are underlined. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the PD-1-targeted IL-10 fusion proteins of the invention.

FIG. 101 depicts sequences for illustrative PD-1-targeted IL-10 fusions in the "anti-X×scIL10-heteroFc" format. IL-10 components are italicized, linkers are double underlined (although as will be appreciated by those in the art, the linkers can be replaced by other linkers), and slashes (/) indicate the border(s) between the IL-10 components, variable regions, and constant/Fc regions. The CDRs are underlined. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the PD-1-targeted IL-10 fusion proteins of the invention. It should be noted that while the IL-10 sequence depicted herein comprise 109L, the sequences can also comprise 109H, as well as sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 102A-FIG. 102C depict sequences for illustrative PD-1-targeted IL-10 fusion in the "anti-X×scIL10-heteroFc" format comprising illustrative IL-10 potency variants. IL-10 components are italicized, linkers are double underlined (although as will be appreciated by those in the art, the linkers can be replaced by other linkers), and slashes (/) indicate the border(s) between the IL-10 components, variable regions, and constant/Fc regions. The CDRs are underlined. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the PD-1-targeted IL-10 fusion proteins of the invention. It should be noted that while the IL-10 sequence depicted herein comprise 109L, the sequences can also comprise 109H, as well as sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 103 depicts sequences for illustrative PD-1-targeted IL-10 fusion in the "anti-X×heteroFc-scIL10" format comprising illustrative IL-10 potency variants. IL-10 components are italicized, linkers are double underlined (although as will be appreciated by those in the art, the linkers can be replaced by other linkers), and slashes (/) indicate the border(s) between the IL-10 components, variable regions, and constant/Fc regions. The CDRs are underlined. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the PD-1-targeted IL-10 fusion proteins of the invention. It should be noted that while the IL-10 sequence depicted herein comprise 109L, the sequences can also comprise 109H, as well as sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 104A-FIG. 104B depict the sequences for illustrative humanized variable regions of non-competing anti-PD-1 mAb A, mAb B, and mAb C. The CDRs are in bold, and the slashes indicate the borders of the variable domains. As note herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the PD-1-targeted IL-10 fusion proteins of the invention.

FIG. 105 depicts epitope binning of a bivalent anti-PD-1 mAb based on nivolumab, in-house produced pembrolizumab, chimeric mAb A, chimeric mAb B, and chimeric mAb C as indicated by normalized BLI-response Octet. Normalized BLI-response greater than 0.5 indicate that an antibody pair does not bin to the same epitope.

FIG. 106A-FIG. 106C depict sequences for illustrative non-competing PD-1-targeted IL-10 fusion comprising illustrative IL-10 potency variants. IL-10 components are italicized, linkers are double underlined (although as will be appreciated by those in the art, the linkers can be replaced by other linkers), and slashes (/) indicate the border(s) between the IL-10 components, variable regions, and constant/Fc regions. The CDRs are underlined. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the PD-1-targeted IL-10 fusion proteins of the invention. It should be noted that while the IL-10 sequence depicted herein comprise 109L, the sequences can also comprise 109H, as well as sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

FIG. 107A-FIG. 107E depict the induction of STAT3 phosphorylation by a PD-1-targeted IL-10 fusion on A) $CD4^+CD45RA^-CD25^+$ T cells, B) $CD4^+CD45RA^+CD25^+$ T cells, C) $CD8^+CD45RA^{low}CD25^{high}$ T cells, D) $CD8^+CD45RA^{high}CD25^{int}$ T cells, and E) Tregs. The data show that the PD-1-targeted IL-10 fusion induced STAT3 phosphorylation on various T cell populations much more potently than the non-targeted IL-10 fusion (XENP25880).

Figure 108A:
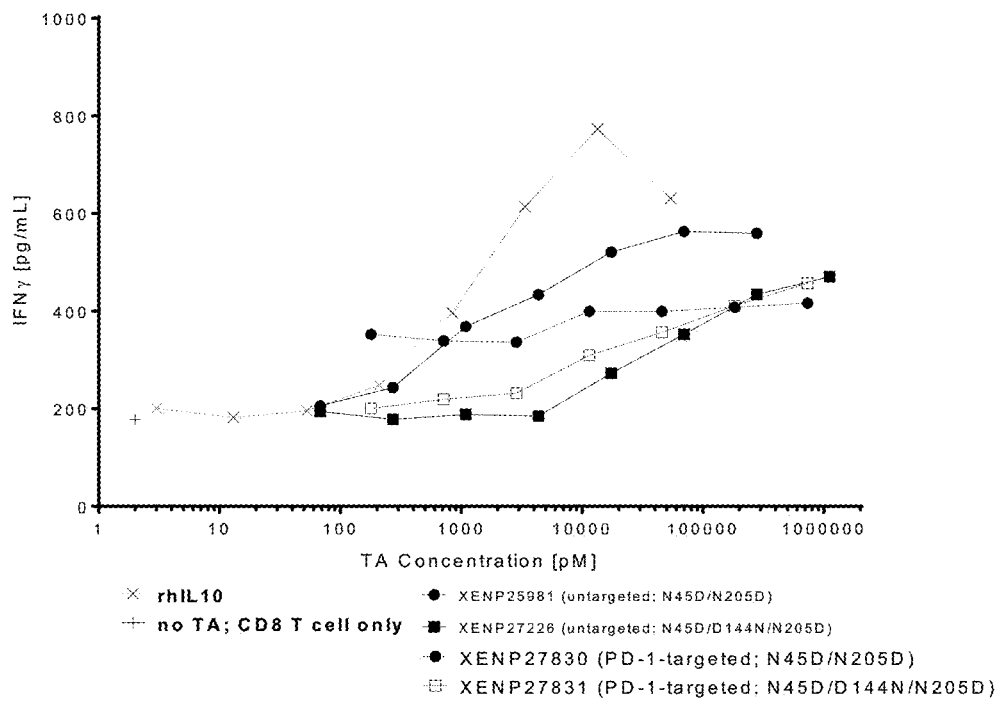
Figure 108B:
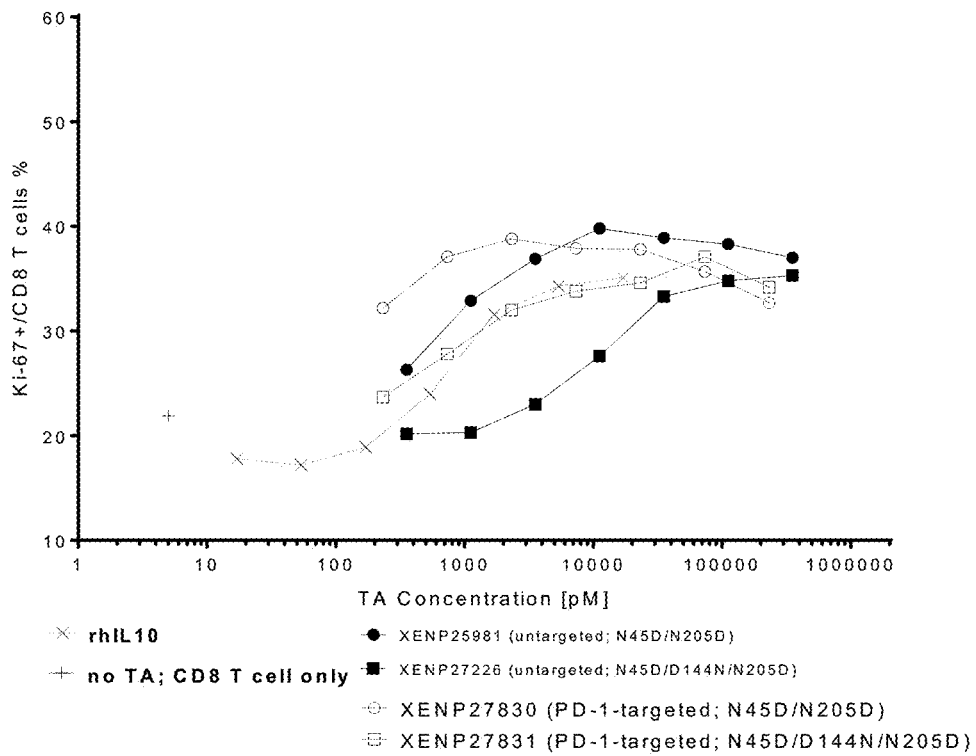
Figure 108C:
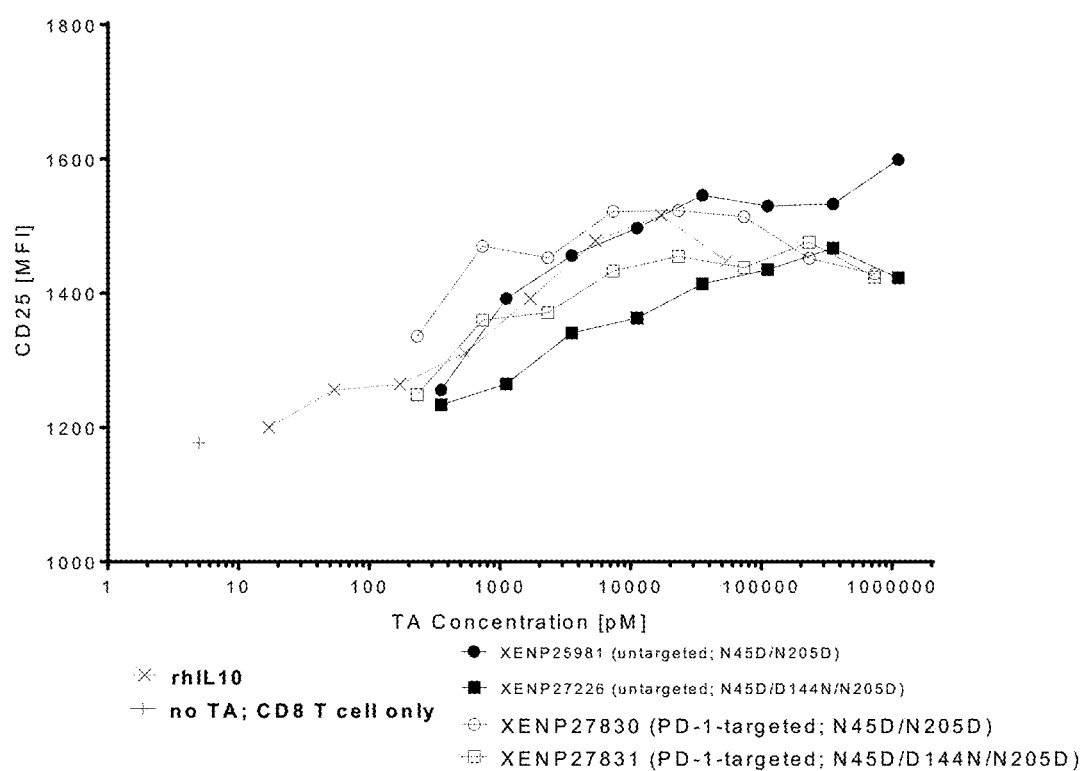

FIG. 108A-FIG. 108C depict the potentiation of A) IFNγ secretion, B) proliferation (as indicated by percentage cells expressing Ki67), and C) activation (as indicated by CD25 expression) of purified CD8$^+$ T cells by PD-1-targeted IL-10 fusions.

Figure 109:
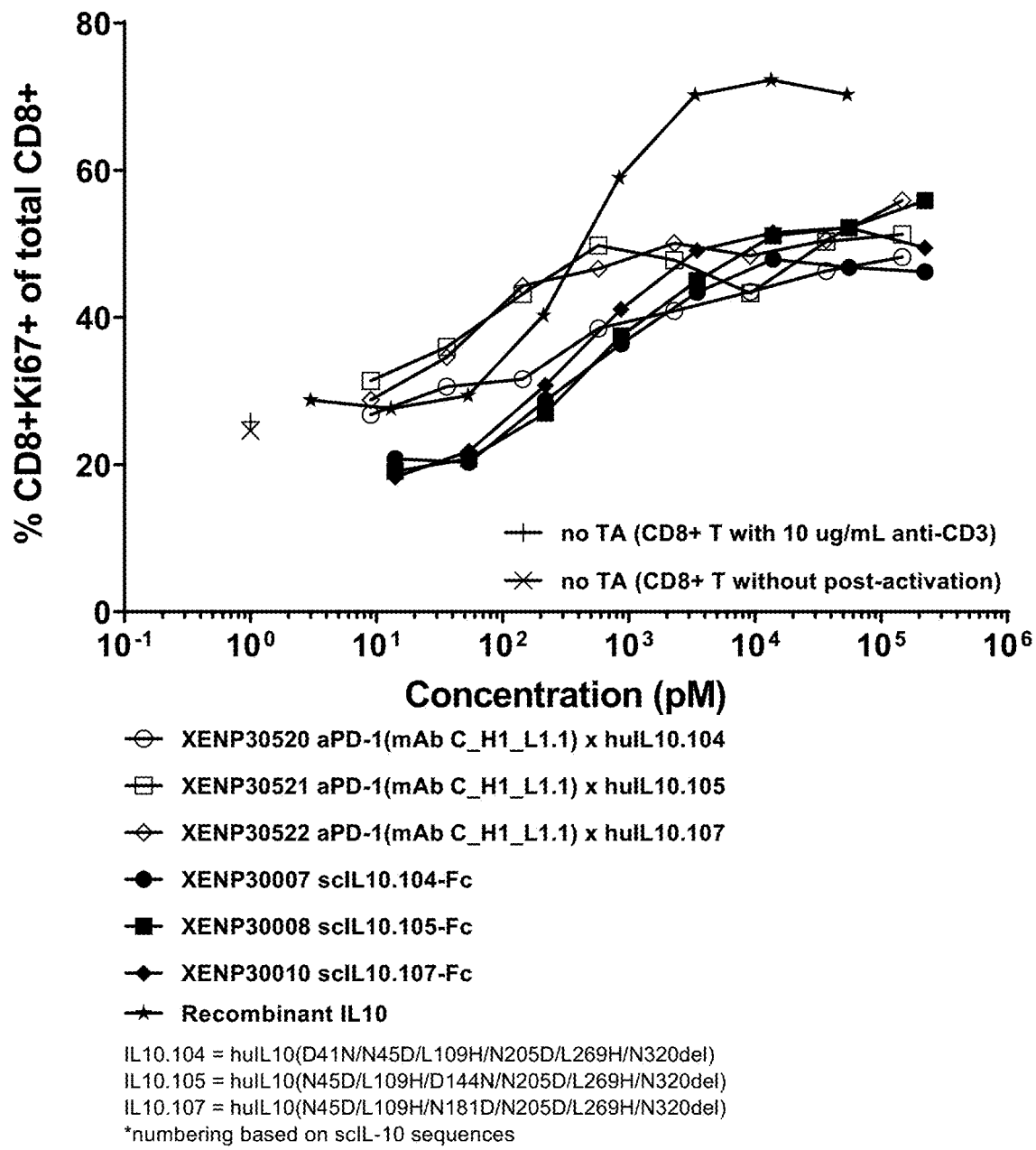

FIG. 109 depicts induction of CD8$^+$ T cell proliferation (as indicated by percentage CD8$^+$Ki67+ of total CD8$^+$ T cell population) by untargeted IL-10 fusion proteins (XENP30007, XENP30008, and XENP30010) and PD-1 targeted IL-10 fusion proteins (XENP30520, XENP30521, and XENP30522) having different scIL-10 potency variants. The data show that for each of the reduced potency IL-10-Fc fusions, potency on induction of CD8$^+$ T cells was restored by PD-1-targeting.

Figure 110:
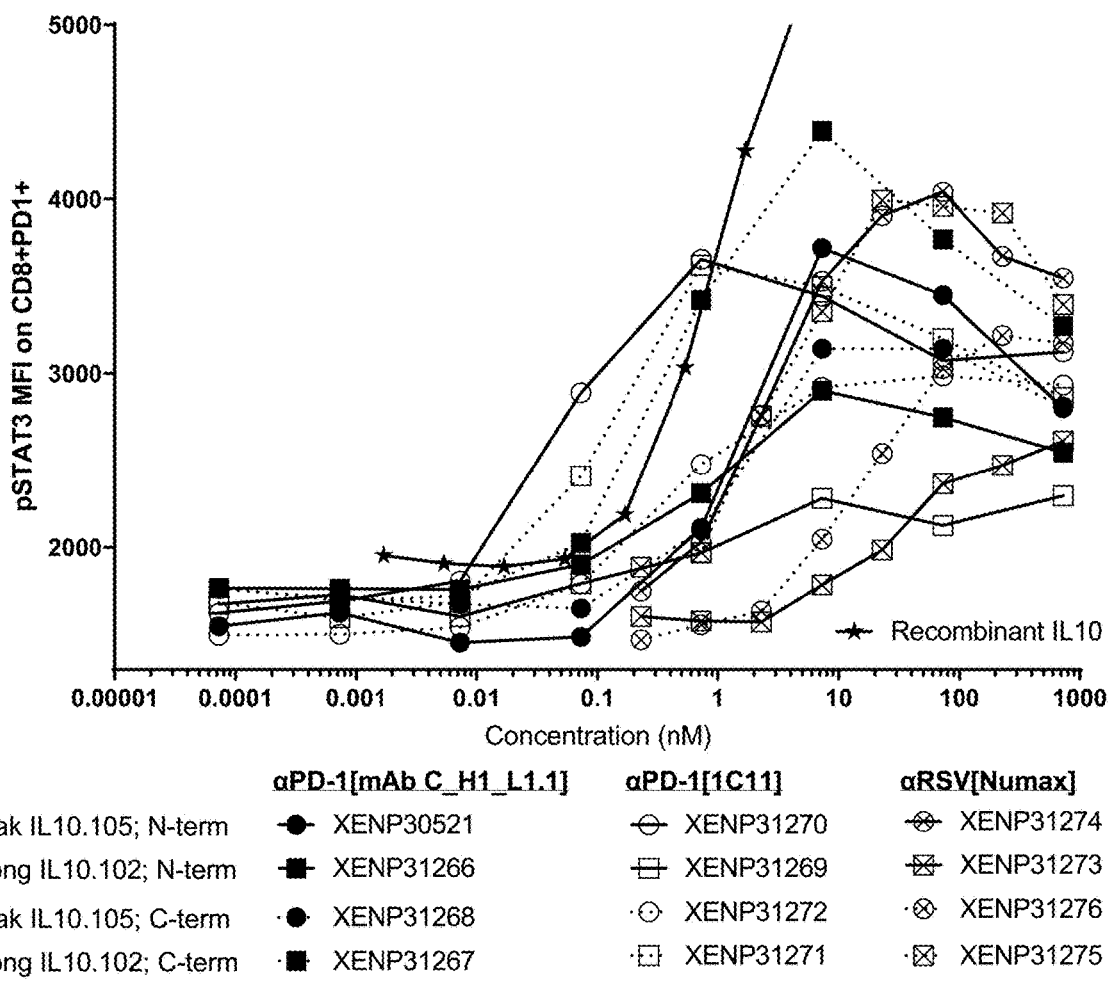

FIG. 110 depicts induction of STAT3 phosphorylation on CD8$^+$PD-1$^+$ T cells by targeted IL-10 fusion proteins having PD-1-targeting arm based on mAb C_H1_L1.1 (XENP30521, XENP31266, XENP31268, and XENP31267), a PD-1-targeting arm based on 1C11 (XENP31270, XENP31269, XENP31272, and XENP31271), or a RSV-targeting arm based on Numax/motavizumab (XENP31274, XENP31273, XENP31276, and XENP31275). The data show that the PD-1-targeted IL-10 fusion proteins were more potent than the corresponding RSV-targeted IL-10 fusion proteins (that is having the same IL-10 variant and same terminal attachment). For the weaker potency IL-10 fusion proteins (having IL10.105), C-terminal attachment of the scIL-10 moiety resulted in reduced potency; and for the stronger potency IL-10 fusion protein, C-terminal attachment of the scIL-10 moiety resulted in enhanced potency.

FIG. 111 depicts the sequences for TIGIT for both human and cynomolgus monkey to facilitate the development of antigen binding domains that bind to both for ease of clinical development.

FIG. 112 depicts sequences for a phage-derived anti-TIGIT antibody with an ablation variant (E233P/L234V/L235A/G236del/S267K, "IgG1_PVA_/S267k"). The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the V$_H$ and V$_L$ domains using other numbering systems.

FIG. 113 depicts the sequences for XENP19351, a bivalent anti-TIGIT mAb based on 10A7 as described in WO 2015/009856, a known blocker of TIGIT/TIGIT ligand interaction. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the V$_H$ and V$_L$ domains using other numbering systems.

FIG. 114 depicts the sequences for XENP19352, a bivalent anti-TIGIT mAb based on 1F4 as described in WO 2015/009856, a known non-blocker of TIGIT/TIGIT ligand interaction. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the V$_H$ and V$_L$ domains using other numbering systems.

Figure 115:
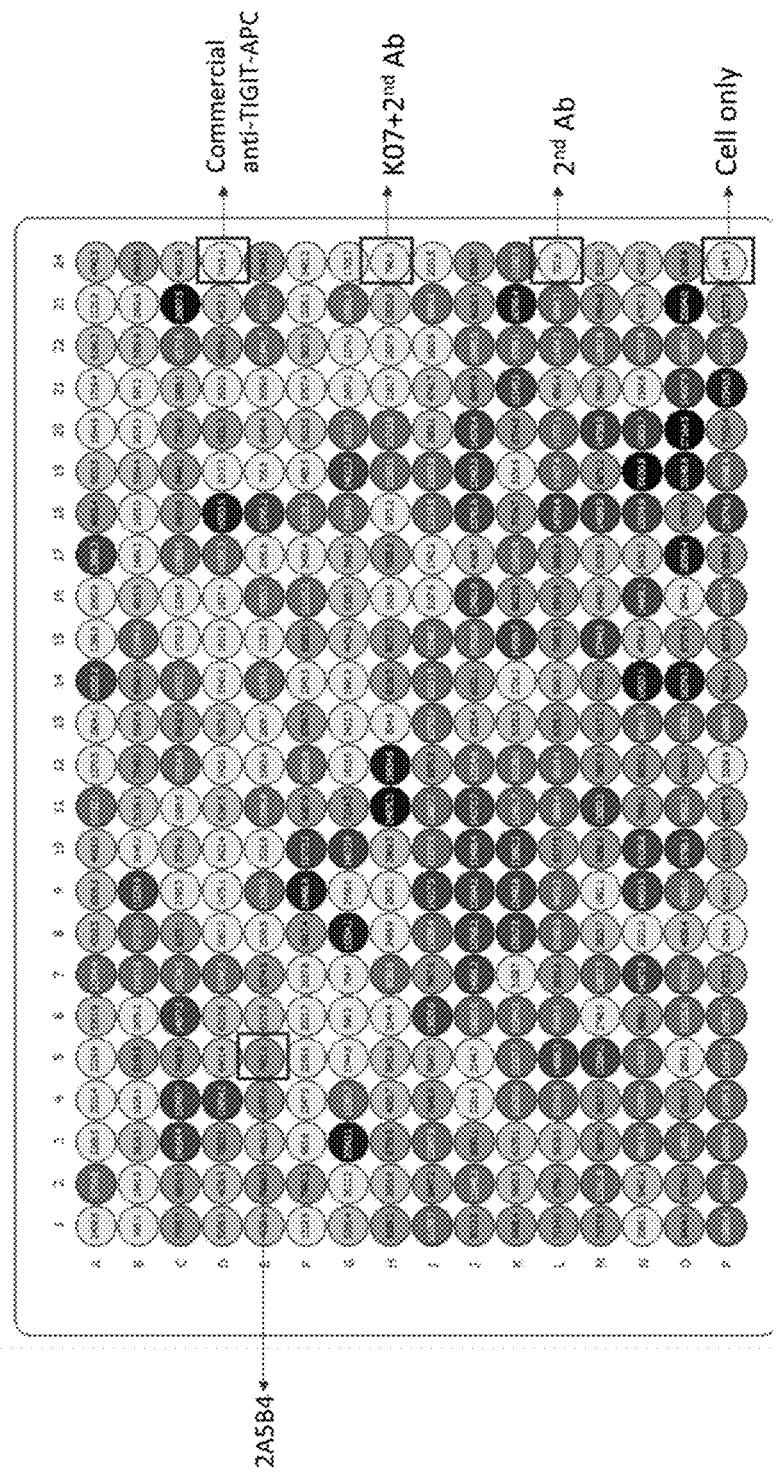

FIG. 115 depicts mean MFI within the single cell gate (indicating binding of phage clones to Jurkat-TIGIT cells) in each well of an illustrative plate containing clone 2A5B4.

Figure 116:
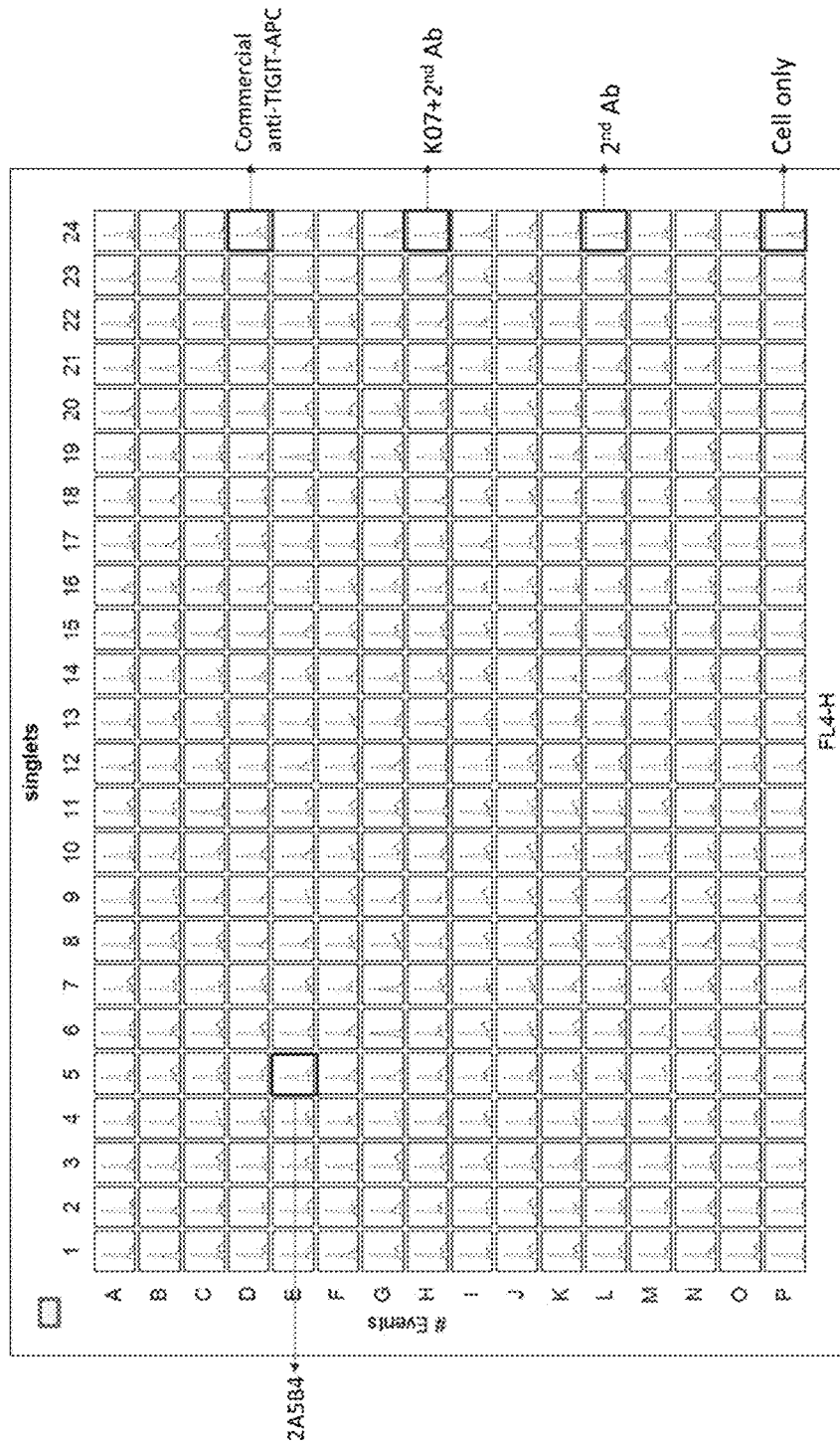

FIG. 116. Jurkat-TIGIT cells within the single cell gate are represented in single parameter histograms (corresponding to each well of an illustrative plate containing clone 2A5B4) to evaluate the relative binding of phage clones with overlay of a control population.

Figure 117:
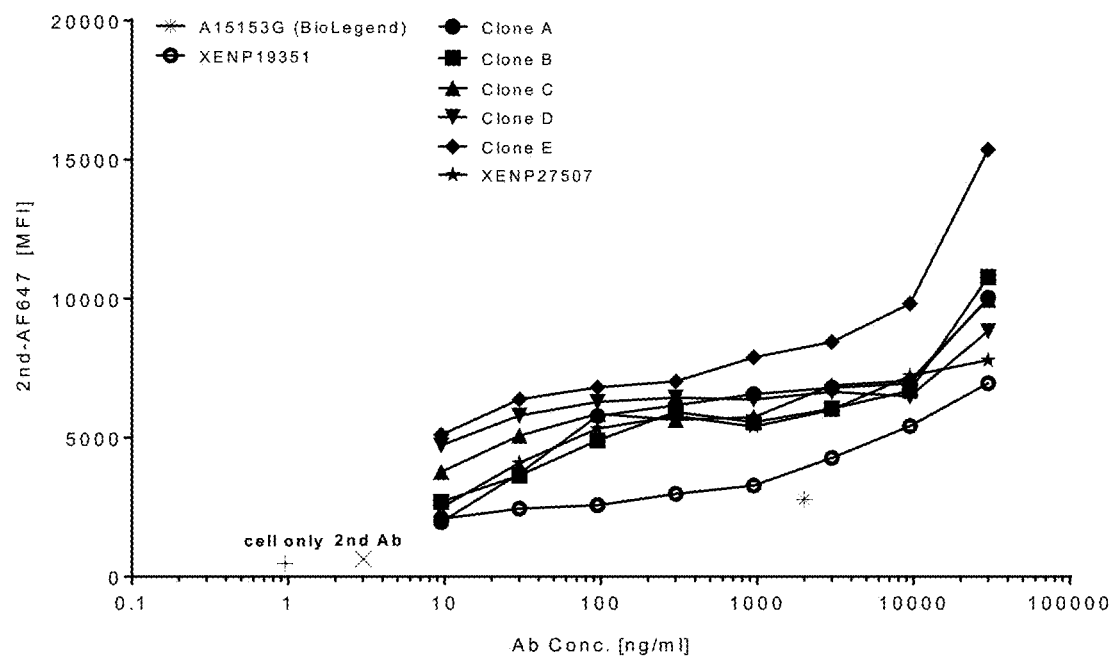

FIG. 117 depicts the binding of XENP27507 (bivalent anti-TIGIT mAb based on 2A5B4), five additional phage-derived anti-TIGIT mAbs as comparators, XENP19351 (control based on 10A7 as described in WO 2015/009856), and a commercial anti-TIGIT antibody to TIGIT-transfected Jurkat cells. The data show a range of binding efficacy and potency.

FIG. 118 depicts apparent dissociation constant (K$_D$), association rate (k$_a$), and dissociation rate (k$_d$) of XENP27507 (bivalent anti-TIGIT mAb based on 2A5B4), five additional phage-derived anti-TIGIT mAbs as comparators, and XENP19351 (control based on 10A7 as described in WO 2015/009856) for human and cynomolgus TIGIT as determined by Octet. The data show that each of the clones bound both human and cynomolgus TIGIT with a range of affinities.

FIG. 119 depicts epitope binning of XENP27507 (bivalent anti-TIGIT mAb based on 2A5B4) and five additional phage-derived anti-TIGIT mAbs as comparators with XENP19351 (a confirmed blocker of TIGIT:TIGIT ligand interaction) and XENP19352 (a confirmed non-blocker of TIGIT:TIGIT ligand interaction) as indicated by normalized BLI-response Octet. Normalized BLI-response greater than 0.5 indicate that an antibody pair does not bin to the same epitope. The data show that each of the phage-derived mAbs binned to the same epitope as XENP19351, suggesting that they are also blockers of TIGIT:TIGIT ligand interactions.

Figure 120A:
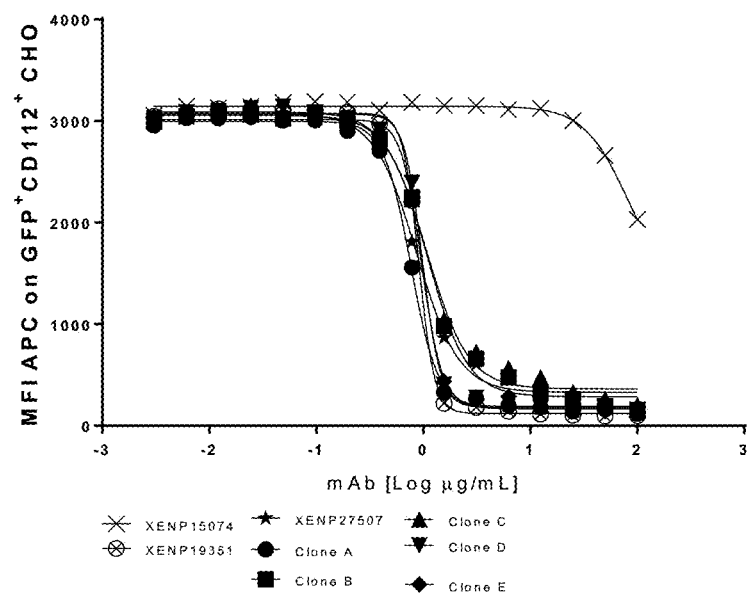
Figure 120B:
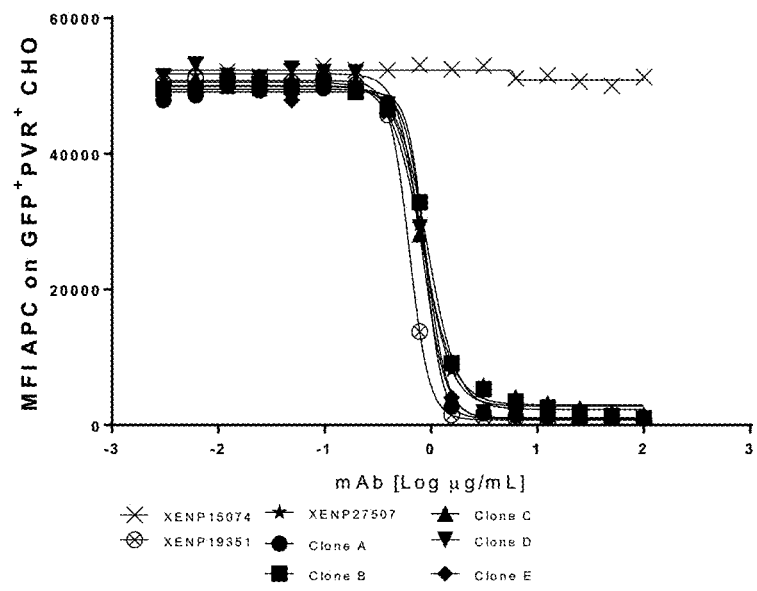

FIG. 120A-FIG. 120B depicts binding of TIGIT-mFc (incubated with indicated concentrations of XENP27507, five additional phage-derived anti-TIGIT mAbs, positive control XENP19351, and negative control anti-RSV mAb XENP15074) to A) CD112-transfected CHO cells and B) PVR-transfected CHO cells. The data show that each of the phage-derived mAbs dose-dependently blocked the binding of TIGIT to its ligands (CD112 and PVR).

Figure 121A:
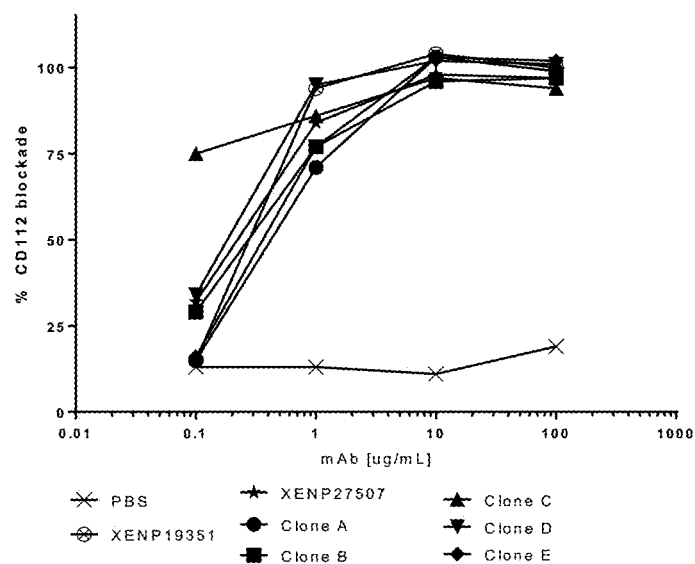
Figure 121B:
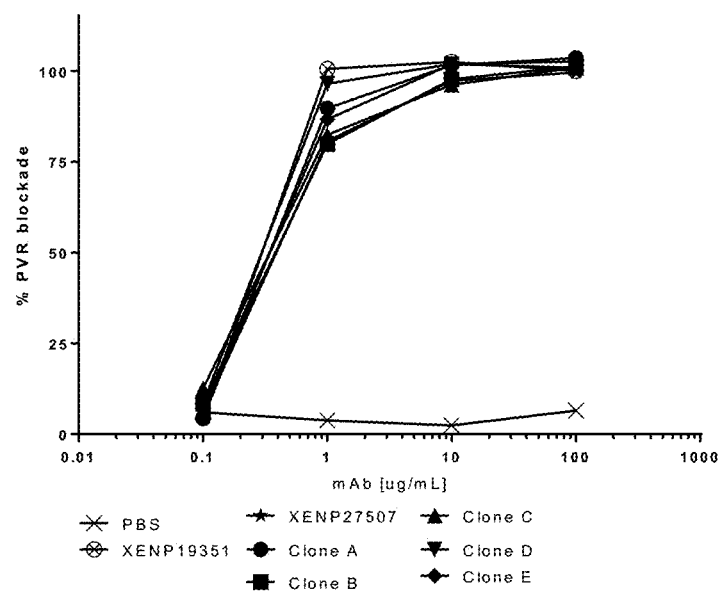

FIG. 121A-FIG. 121B depict the percentage of blockade of TIGIT-mFc to A) CD112-transfected CHO cells and B) PVR-transfected CHO cells by indicated concentrations of XENP27507, five additional phage-derived anti-TIGIT mAbs as comparators, positive control XENP19351, and negative control PBS. The data show that each of the phage-derived mAbs dose-dependently blocked the binding of TIGIT to its ligands (CD112 and PVR).

FIG. 122A-FIG. 122C depict the variable heavy and variable light chains for illustrative anti-TIGIT ABDs which find use in the formats of the invention. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the V$_H$ and V$_L$ domains using other numbering systems.

FIG. 123A-FIG. 123B depict sequences for illustrative TIGIT-targeted IL-10 fusion comprising illustrative IL-10 potency variants. IL-10 components are italicized, linkers are double underlined (although as will be appreciated by those in the art, the linkers can be replaced by other linkers), and slashes (/) indicate the border(s) between the IL-10 components, variable regions, and constant/Fc regions. The CDRs are underlined. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the TIGIT-targeted IL-10 fusion proteins of the invention. It should be noted that while the IL-10 sequence depicted herein comprise 109L, the sequences can also comprise 109H, as well as sequences that are 90, 95, 98 and 99% identical (as defined herein), and/or contain from 1, 2, 3, 4, 5, 6, 7, 8, 9 or 10 additional amino acid substitutions, including substitutions to modulate affinity/potency, introduce/remove disulfide bridges, improve yield, remove charge variants, remove glycosylation sites, and/or improve stability.

Figure 124:
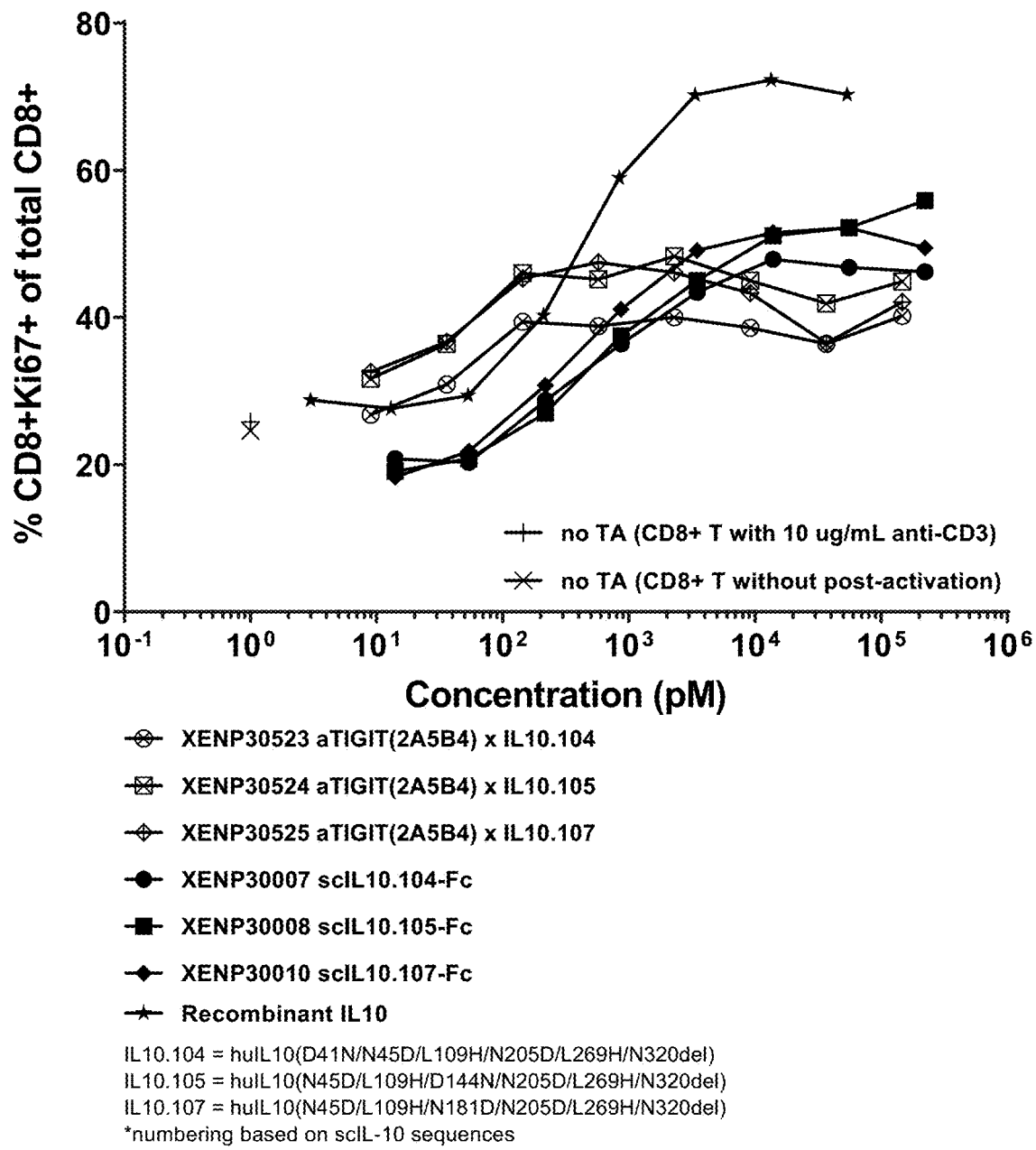

FIG. 124 depicts induction of CD8+ T cell proliferation (as indicated by percentage CD8+Ki67+ of total CD8+ T cell population) by untargeted IL-10 fusion proteins (XENP30007, XENP30008, and XENP30010) and TIGIT-targeted IL-10 fusion proteins (XENP30523, XENP30524, and XENP30525) having different scIL-10 potency variants. The data show that for each of the reduced potency IL-10-Fc fusions, potency on induction of CD8+ T cells was restored by TIGIT-targeting.

DETAILED DESCRIPTION OF THE INVENTION

I. Definitions

In order that the application may be more completely understood, several definitions are set forth below. Such definitions are meant to encompass grammatical equivalents.

By "ablation" herein is meant a decrease or removal of binding and/or activity. Thus for example, "ablating FcγR binding" means the Fc region amino acid variant has less than 50% starting binding as compared to an Fc region not containing the specific variant, with less than 70-80-90-95-98% loss of binding being preferred, and in general, with the binding being below the level of detectable binding in a Biacore assay. Of particular use in the ablation of FcγR binding are those shown in FIG. 7. However, unless otherwise noted, the Fc monomers of the invention retain binding to the FcRn.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity. As is discussed herein, many embodiments of the invention ablate ADCC activity entirely.

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g., the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y or 272Y refers to a variant polypeptide, in this case an Fc variant, in which the glutamic acid at position 272 is replaced with tyrosine. For clarity, a protein which has been engineered to change the nucleic acid coding sequence but not to change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid residue or sequence at a particular position in a parent polypeptide sequence. For example, –233E designates an insertion of glutamic acid after position 233 and before position 234. Additionally, –233ADE or A233ADE designates an insertion of AlaAspGlu after position 233 and before position 234.

By "amino acid deletion" or "deletion" as used herein is meant the removal of an amino acid residue or sequence at a particular position in a parent polypeptide sequence. For example, E233-, E233#, E233( ) or E233del designates a deletion of glutamic acid at position 233. Additionally, EDA233- or EDA233# designates a deletion of the sequence GluAspAla that begins at position 233.

By "variant protein", "protein variant", or "variant" as used herein is meant a protein that differs from that of a parent protein by virtue of at least one modification. Protein variant may refer to the protein itself, a composition comprising the protein, the amino acid sequence that encodes it, or the DNA sequence that encodes it. Preferably, the protein variant has at least one amino acid modification compared to the parent protein, e.g. from about one to about seventy amino acid modifications, and preferably from about one to about five amino acid modifications compared to the parent. The modification can be an addition, deletion, or substitution. As described below, in some embodiments the parent polypeptide, for example an Fc parent polypeptide, is a human wild type sequence, such as the Fc region from IgG1, IgG2, IgG3 or IgG4. The protein variant sequence herein will preferably possess at least about 80% identity with a parent protein sequence, and most preferably at least about 90% identity, more preferably at least about 95-98-99% identity.

As used herein, by "protein" is meant at least two covalently attached amino acids, which includes proteins, polypeptides, oligopeptides and peptides. When a biologically functional molecule comprises two or more proteins, each protein may be referred to as a "monomer" or as a "subunit" or as a "domain"; and the biologically functional molecule may be referred to as a "complex".

By "residue" as used herein is meant a position in a protein and its associated amino acid identity. For example, Asparagine 297 (also referred to as Asn297 or N297) is a residue at position 297 in the human antibody IgG1.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" or "Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin (β2-microglobulin) and the heavy chain is encoded by the FcRn gene. Unless otherwise noted herein, FcRn or an FcRn protein refers to the complex of FcRn heavy chain with β2-microglobulin. A variety of Fc variants can be used to increase binding to the FcRn, and in some cases, to increase serum half-life. In general, unless otherwise noted, the Fc monomers of the invention retain binding to the FcRn (and, as noted below, can include amino acid variants to increase binding to the FcRn).

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it.

By "Fc" or "Fc region" or "Fc domain" as used herein is meant the polypeptide comprising the constant region of an antibody, in some instances, excluding all of the first constant region immunoglobulin domain (e.g., CH1) or a portion thereof, and in some cases, optionally including all or part of the hinge. For IgG, the Fc domain comprises immunoglobulin domains CH2 and CH3 (Cγ2 and Cγ3), and optionally all or a portion of the hinge region between CH1 (Cγ1) and CH2 (Cγ2). Thus, in some cases, the Fc domain includes, from N- to C-terminal, CH2-CH3 and hinge-CH2-CH3. In some embodiments, the Fc domain is that from IgG1, IgG2, IgG3 or IgG4, with IgG1 hinge-CH2-CH3 and IgG4 hinge-CH2-CH3 finding particular use in many embodiments. Additionally, in the case of human IgG1 Fc domains, frequently the hinge includes a C220S amino acid substitution. Furthermore, in the case of human IgG4 Fc domains, frequently the hinge includes a S228P amino acid substitution. Although the boundaries of the Fc region may vary, the human IgG heavy chain Fc region is usually defined to include residues E216, C226, or A231 to its carboxyl-terminus, wherein the numbering is according to the EU index as in Kabat. In some embodiments, as is more fully described below, amino acid modifications are made to the Fc region, for example to alter binding to one or more FcγR or to the FcRn.

As will be appreciated by those in the art, the exact numbering and placement of the heavy constant region domains can be different among different numbering systems. A useful comparison of heavy constant region numbering according to EU and Kabat is as below, see Edelman et al., 1969, Proc Natl Acad Sci USA 63:78-85 and Kabat et al., 1991, Sequences of Proteins of Immunological Interest, 5th Ed., United States Public Health Service, National Institutes of Health, Bethesda, entirely incorporated by reference.

TABLE 1

|  | EU Numbering | Kabat Numbering |
| --- | --- | --- |
| CH1 | 118-215 | 114-223 |
| Hinge | 216-230 | 226-243 |
| CH2 | 231-340 | 244-360 |
| CH3 | 341-447 | 361-478 |

"Fc variant" or "variant Fc" as used herein is meant a protein comprising an amino acid modification in an Fc domain. The modification can be an addition, deletion, or substitution. The Fc variants of the present invention are defined according to the amino acid modifications that compose them. Thus, for example, N434S or 434S is an Fc variant with the substitution for serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as 434S/428L, and so on. For all positions discussed in the present invention that relate to antibodies or derivatives and fragments thereof, unless otherwise noted, amino acid position numbering is according to the EU index. The EU index or EU index as in Kabat or EU numbering scheme refers to the numbering of the EU antibody (Edelman et al., 1969, Proc Natl Acad Sci USA 63:78-85, hereby entirely incorporated by reference). The modification can be an addition, deletion, or substitution.

By "fusion protein" as used herein is meant covalent joining of at least two proteins or protein domains. Fusion proteins may comprise artificial sequences, e.g. a domain linker, variant Fc domains, a variant IL-10 domain, etc. as described herein. By "Fc fusion protein" or "immunoadhesin" herein is meant a protein comprising an Fc region, generally linked (optionally through a domain linker, as described herein) to one or more different protein domains. Accordingly, an "IL-10 Fc fusion" comprises an Fc region linked (optionally but usually through a domain linker) to an IL-10, an IL-10(A-D) domain, an IL10(E-F) domain, a monomeric IL-10, and/or single-chain IL-10 complex (scIL-10), as described herein. In some instances, two Fc fusion proteins can form a homodimeric Fc fusion protein or a heterodimeric Fc fusion protein with the latter being preferred. In some cases, one monomer of the heterodimeric Fc fusion protein comprises an Fc domain alone (e.g., an empty Fc domain) and the other monomer is an Fc fusion, comprising a variant Fc domain and an IL-10 domain, as outlined herein.

By "position" as used herein is meant a location in the sequence of a protein. Positions may be numbered sequentially, or according to an established format, for example the EU index for antibody numbering.

By "strandedness" in the context of the monomers of the heterodimeric proteins of the invention herein is meant that, similar to the two strands of DNA that "match", heterodimerization variants are incorporated into each monomer so as to preserve, create, and/or enhance the ability to "match" to form heterodimers. For example, if some pI variants are engineered into monomer A (e.g. making the pI higher), then steric variants that are "charge pairs" that can be utilized as well do not interfere with the pI variants, e.g. the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer that incorporates one set of the pair will go, such that pI separation is maximized using the pI of the skews as well.

By "wild type or WT" herein is meant an amino acid sequence or a nucleotide sequence that is found in nature, including allelic variations. A WT protein has an amino acid sequence or a nucleotide sequence that has not been intentionally modified.

The heterodimeric proteins of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated protein," refers to a protein which is substantially free of other proteins from a cell culture such as host cell proteins. "Recombinant" means the proteins are generated using recombinant nucleic acid techniques in exogeneous host cells.

"Percent (%) amino acid sequence identity" with respect to a protein sequence is defined as the percentage of amino acid residues in a candidate sequence that are identical with the amino acid residues in the specific (parental) sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. One particular program is the ALIGN-2 program outlined at paragraphs [0279] to [0280] of US Pub. No. 20160244525, hereby incorporated by reference.

The degree of identity between an amino acid sequence of the present invention ("invention sequence") and the parental amino acid sequence is calculated as the number of exact matches in an alignment of the two sequences, divided by the length of the "invention sequence," or the length of the parental sequence, whichever is the shortest. The result is expressed in percent identity.

In some embodiments, two or more amino acid sequences are at least 50%, 60%, 70%, 80%, or 90% identical. In some embodiments, two or more amino acid sequences are at least 95%, 97%, 98%, 99%, or even 100% identical.

By "IL-10 monomer" or "IL-10 monomer domain" herein is meant a monomer composed of 6 helices, herein referred to as helices A-F. As discussed herein, the IL10 monomer domain can be a wild-type human sequence (e.g. SEQ ID NO:1 from FIG. 1) or a variant thereof (e.g. see FIGS. 35A-35D, for example). Note that residue 109 (numbering based on mature form IL10 sequence) can be either H or L in the context of the formats and sequences described herein.

The IL-10 monomers of the invention, when presented together in the formats described herein, bind the IL-10 receptor, which consists of two alpha and two beta subunits (or R1 and R2 subunits). The strength, or affinity, of specific binding can be expressed in terms of dissociation constant ($K_D$) of the interaction, wherein a smaller $K_D$ represents greater affinity and a larger $K_D$ represents lower affinity. Binding properties can be determined by methods well known in the art such as bio-layer interferometry and surface plasmon resonance based methods. One such method entails measuring the rates of antigen-binding site/antigen or receptor/ligand complex association and dissociation, wherein rates depend on the concentration of the complex partners, the affinity of the interaction, and geometric parameters that equally influence the rate in both directions. Thus, both the association rate ($k_a$) and the dissociation rate ($k_d$) can be determined, and the ratio of $k_d/k_a$ is equal to the dissociation constant $K_D$ (See Nature 361:186-187 (1993) and Davies et al. (1990) Annual Rev Biochem 59:439-473).

Specific binding for a particular molecule can be exhibited, for example, by a molecule having a $K_D$ for a ligand (generally a receptor, in this case) of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ at least about $10^{-11}$ M, at least about $10^{-12}$ M, or greater. Typically, a molecule that specifically binds its receptor will have a $K_D$ that is 20-, 50-, 100-, 500-, 1000-, 5,000-, 10,000- or more times greater for a control molecule relative to the receptor.

Also, specific binding for a particular molecule can be exhibited, for example, by a molecule having a $k_a$ or association rate for a ligand or receptor of at least 20-, 50-, 100-, 500-, 1000-, 5,000-, 10,000- or more times greater for the receptor relative to a control.

By "fused" or "covalently linked" is herein meant that the components (e.g., an IL-10 monomer domain and an Fc domain) are linked by peptide bonds, either directly or indirectly via domain linkers, outlined herein.

As used herein, the term "single-chain" refers to a molecule comprising amino acid domains linearly linked by peptide bonds. In certain embodiments, the biologically functional IL10 is a single chain IL-10 complex or "scIL10", i.e. two IL-10 monomer domains are fused to form a single peptide chain. In a particular such embodiment, the C-terminus of a first IL-10 monomer is connected to the N-terminus of a second IL-10 monomer, designated herein as "scIL10". It should be noted that these single chain constructs, where two IL-10 monomers are on the same amino acid chain, still are part of a heterodimeric molecule containing two amino acid chains (e.g. the scIL10) component and the "empty arm" Fc component).

II. Dimeric Fc Fusion Proteins

In some aspects, the present invention relates to dimeric Fc fusion proteins that include an Fc region, generally linked (optionally through a domain linker) to one or more different protein domains.

In one aspect, the dimeric Fc fusion protein is a homodimeric Fc fusion protein. In another aspect, the dimeric Fc fusion protein is a heterodimeric Fc fusion protein. As will be appreciated, discussion herein of components of the fusion proteins encompassed by the present disclosure is applicable to both homodimeric and heterodimeric Fc fusion proteins as appropriate, unless otherwise specified.

In one aspect, the dimeric Fc fusion protein is an IL-10 dimeric Fc fusion protein that includes IL-10 monomer domains in different orientations, such that they present together to bind to the IL10 receptor. The Fc domains can be derived from IgG Fc domains, e.g., IgG1, IgG2, IgG3 or IgG4 Fc domains, with IgG1 Fc domains finding particular use in the invention. As described herein, IgG1 Fc domains may be used, often, but not always in conjunction with ablation variants to ablate effector function. Similarly, when low effector function is desired, IgG4 Fc domains may be used.

For any of the Fc fusion proteins described herein, the carboxy-terminal portion of each chain defines a constant region primarily responsible for effector function. Kabat et al. collected numerous primary sequences of the variable regions of heavy chains and light chains. Based on the degree of conservation of the sequences, they classified individual primary sequences into the CDRs and the framework and made a list thereof (see SEQUENCES OF IMMUNOLOGICAL INTEREST, 5th edition, NIH publication, No. 91-3242, E. A. Kabat et al., entirely incorporated by reference). Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g., Kabat et al., supra (1991)).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-215 according to the EU index as in Kabat. "Hinge" refers to positions 216-230 according to the EU index as in Kabat. "CH2" refers to positions 231-340 according to the EU index as in Kabat, and "CH3" refers to positions 341-447 according to the EU index as in Kabat. As shown in Table 1, the exact numbering and placement of the heavy chain domains can be different among different numbering systems. As shown herein and described below, the pI variants can be in one or more of the CH regions, as well as the hinge region, discussed below.

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-215 according to the EU index as in Kabat. "Hinge" refers to positions 216-230 according to the EU index as in Kabat. "CH2" refers to positions 231-340 according to the EU index as in Kabat, and "CH3" refers to positions 341-447 according to the EU index as in Kabat. As shown in Table 1, the exact numbering and placement of the heavy chain domains can be different among different numbering systems. As shown herein and described below, the pI variants can be in one or more of the CH regions, as well as the hinge region, discussed below.

Another type of Ig domain of the heavy chain is the hinge region. By "hinge" or "hinge region" or "antibody hinge region" or "immunoglobulin hinge region" herein is meant the flexible polypeptide comprising the amino acids between the first and second heavy chain constant domains of an antibody. Structurally, the IgG CH1 domain ends at EU position 215, and the IgG CH2 domain begins at residue EU position 231. Thus for IgG the antibody hinge is herein defined to include positions 216 (E216 in IgG1) to 230 (P230 in IgG1), wherein the numbering is according to the EU index as in Kabat. In some embodiments, for example in the context of an Fc region, the hinge is included, generally referring to positions 216-230. As noted herein, pI variants can be made in the hinge region as well.

As described herein and known in the art, the dimeric proteins of the invention comprise different domains, which can be overlapping as well. These domains include, but are not limited to, the Fc domain, the CH2 domain, the CH3 domain and the hinge domain, and an IL-10 monomer domain. As described herein, these domains are linked together in different formats, as generally outlined in FIGS. 16, 20, 23, and 29.

In some embodiments described herein, when a protein domain, e.g., an IL-10 monomer, is attached to an Fc domain, it is the C-terminus of the protein domain that is attached to the N-terminus of an Fc domain. In other embodiments described herein, when a protein domain, e.g., an IL-10 monomer, is attached to an Fc domain it is the N-terminus of the protein fragment that is attached to the C-terminus of the Fc domain.

In some of the constructs and sequences outlined herein of an Fc domain protein, the C-terminus of the IL-10 monomer is attached to the N-terminus of a domain linker, the C-terminus of which is attached to the N-terminus of a constant Fc domain (N-IL-10 monomer domain-linker-Fc domain-C) although, as will be appreciated, the order of the components can be switched: (N-Fc domain-linker-IL-10 monomer domain-C). In other constructs and sequences outlined herein, the C-terminus of a first protein domain is attached to the N-terminus of a second protein domain, optionally via a domain linker, the C-terminus of the second protein domain is attached to the N-terminus of a constant Fc domain, optionally via a domain linker. In yet another construct, the N-terminus of a first protein domain is attached to the C-terminus of a second protein domain, optionally via a domain linker, the N-terminus of the second protein fragment is attached to the C-terminus of a constant Fc domain, optionally via a domain linker. In yet other constructs and sequences outlined herein, a constant Fc domain that is not attached to a first protein fragment or a second protein fragment is provided. A dimeric Fc fusion protein can contain two or more of the exemplary monomeric Fc domain proteins described herein—as will be appreciated, a homodimeric Fc fusion protein will contain two identical monomer Fc domain proteins, whereas a heterodimeric Fc fusion protein will contain two or more different monomer Fc domain proteins.

In some embodiments, the linker is a "domain linker", used to link any two domains as outlined herein together, some of which are depicted in the figures. While any suitable linker can be used, many embodiments utilize a glycine-serine polymer, including for example (GS)n (SEQ ID NO: 34), (GSGGS)n (SEQ ID NO: 35), (GGGGS)n (SEQ ID NO: 36), and (GGGS)n (SEQ ID NO: 37), where n is an integer of at least one (and generally from 0 to 1 to 2 to 3 to 4 to 5) as well as any peptide sequence that allows for recombinant attachment of the two domains with sufficient length and flexibility to allow each domain to retain its biological function. In some cases, and with attention being paid to "strandedness", as outlined below, the linker is a charged domain linker.

As noted above, the present disclosure encompasses both heterodimeric and non-heterodimeric (also referred to herein as homodimeric) formats. As will be appreciated by those in the art, such homodimeric formats can be monospecific antibodies (e.g. "traditional monoclonal antibodies" and/or Fc fusion proteins that bind to a single target) or non-heterodimeric bispecific formats. Accordingly, the present invention provides monoclonal (monospecific) Fc fusion proteins or non-heterodimeric bispecific proteins. Non-heterodimeric bispecific formats are known in the art, and include a number of different formats as generally depicted in Spiess et al., Molecular Immunology (67):95-106 (2015) and Kontermann, mAbs 4:2, 182-197 (2012), both of which are expressly incorporated by reference and in particular for the figures, legends and citations to the formats therein.

In some embodiments the present invention provides heterodimeric Fc fusion proteins that rely on the use of two different heavy chain variant Fc sequences, that will self-assemble to form a heterodimeric Fc domain fusion polypeptide. In one embodiment, heterodimeric Fc fusion proteins contain at least two constant domains which can be engineered to produce heterodimers, such as pI engineering. Other Fc domains that can be used include fragments that contain one or more of the CH1, CH2, CH3, and hinge domains of the invention that have been pI engineered. In particular, the formats depicted in FIGS. 16C-D, 20A-B, 23C-F, and 29A-D are heterodimeric Fc fusion proteins, meaning that the protein has two associated Fc sequences self-assembled into a heterodimeric Fc domain and at least one protein fragment (e.g., 1, 2 or more protein fragments). In some cases, a first protein fragment is linked to a first Fc sequence and a second protein fragment is linked to a second Fc sequence. In some cases, the heterodimeric Fc fusion protein contains a first protein fragment linked to a second protein fragment which is linked to a first Fc sequence, and a second Fc sequence that is not linked to either the first or second protein fragments.

The present invention is directed to novel constructs to provide dimeric Fc fusion proteins that allow binding to one or more binding partners, ligands or receptors. The Fc fusion constructs are based on the self-assembling nature of the two Fc domains of the heavy chains of antibodies, e.g., two "monomers" that assemble into a "dimer". Heterodimeric Fc fusion formats are made by altering the amino acid sequence of each monomer as more fully discussed below. Thus, the present invention is generally directed to the creation of non-heterodimeric and heterodimeric Fc fusion proteins that can co-engage binding partner(s) or ligand(s) or receptor(s) in several ways. In further embodiments, the heterodimeric Fc fusion proteins rely on amino acid variants in the constant regions that are different on each chain to promote heterodimeric formation and/or allow for ease of purification of heterodimers over the homodimers. There are a number of mechanisms that can be used to generate the heterodimers of the present invention. In addition, as will be appreciated by those in the art, these mechanisms can be combined to ensure high heterodimerization. Thus, amino acid variants that lead to the production of heterodimers are referred to as "heterodimerization variants". As discussed below, heterodimerization variants can include steric variants (e.g. the "knobs and holes" or "skew" variants described below and the "charge pairs" variants described below) as well as "pI variants", which allows purification of homodimers away from heterodimers. As is generally described in WO2014/145806, hereby incorporated by reference in its entirety and specifically as below for the discussion of "heterodimerization variants", useful mechanisms for heterodimerization include "knobs and holes" ("KIH"; sometimes described herein as "skew" variants (see discussion in WO2014/145806)), "electrostatic steering" or "charge pairs" as described in WO2014/145806, pI variants as described in WO2014/145806, and general additional Fc variants as outlined in WO2014/145806 and below.

In the present invention, there are several basic mechanisms that can lead to ease of purifying heterodimeric proteins and antibodies; one relies on the use of pI variants, such that each monomer, and subsequently each dimeric species, has a different pI, thus allowing the isoelectric purification of A-A, A-B and B-B dimeric proteins. Alternatively, some formats also allow separation on the basis of size. As is further outlined below, it is also possible to "skew" the formation of heterodimers over homodimers. Thus, a combination of steric heterodimerization variants and pI or charge pair variants find particular use in the invention.

In general, embodiments of particular use in the present invention rely on sets of variants that include skew variants, that encourage heterodimerization formation over homodimerization formation, coupled with pI variants, which increase the pI difference between the two monomers and each dimeric species.

Additionally, as more fully outlined below, depending on the format of the heterodimer Fc fusion protein, pI variants can be either contained within the constant and/or Fc domains of a monomer, or domain linkers can be used. That is, the invention provides pI variants that are on one or both of the monomers, and/or charged domain linkers as well. In addition, additional amino acid engineering for alternative functionalities may also confer pI changes, such as Fc, FcRn and KO variants.

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B can be changed, with the pI of monomer A increasing and the pI of monomer B decreasing. As discussed, the pI changes of either or both monomers can be done by removing or adding a charged residue (e.g., a neutral amino acid is replaced by a positively or negatively charged amino acid residue, e.g., glutamine to glutamic acid), changing a charged residue from positive or negative to the opposite charge (e.g. aspartic acid to lysine) or changing a charged residue to a neutral residue (e.g., loss of a charge; lysine to serine.). A number of these variants are shown in the Figures.

Accordingly, this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease its pI (wt A: B+ or wt A: B−), or by increasing one region and decreasing the other region (A+: B− or A−: B+).

Thus, in general, a component of some embodiments of the present invention are amino acid variants in the constant regions that are directed to altering the isoelectric point (pI) of at least one, if not both, of the monomers of a dimeric protein by incorporating amino acid substitutions ("pI variants" or "pI substitutions") into one or both of the monomers. The separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the components. That is, to determine which monomer to engineer or in which "direction" (e.g., more positive or more negative), the sequences of the Fc domains, and in some cases, the protein domain(s) linked to the Fc domain are calculated and a decision is made from there. As is known in the art, different Fc domains and/or protein domains will have different starting pIs which are exploited in the present invention. In general, as outlined herein, the pIs are engineered to result in a total pI difference of each monomer of at least about 0.1 logs, with 0.2 to 0.5 being preferred as outlined herein.

Furthermore, as will be appreciated by those in the art and outlined herein, in some embodiments, heterodimers can be separated from homodimers on the basis of size. As shown in the Figures, for example, several of the formats allow separation of heterodimers and homodimers on the basis of size.

In the case where pI variants are used to achieve heterodimerization, by using the constant region(s) of Fc domains(s), a more modular approach to designing and purifying heterodimeric Fc fusion proteins is provided. Thus, in some embodiments, heterodimerization variants (including skew and purification heterodimerization variants) must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g. the minimization or avoidance of non-human residues at any particular position.

A side benefit that can occur with this pI engineering is also the extension of serum half-life and increased FcRn binding. That is, as described in U.S. Ser. No. 13/194,904 (incorporated by reference in its entirety), lowering the pI of antibody constant domains (including those found in antibodies and Fc fusions) can lead to longer serum retention in vivo. These pI variants for increased serum half life also facilitate pI changes for purification.

In addition, it should be noted that the pI variants of the heterodimerization variants give an additional benefit for the analytics and quality control process of Fc fusion proteins, as the ability to either eliminate, minimize and distinguish when homodimers are present is significant. Similarly, the ability to reliably test the reproducibility of the heterodimeric Fc fusion protein production is important.

A. Heterodimerization Variants

The present invention provides heterodimeric proteins, including heterodimeric Fc fusion proteins in a variety of formats, which utilize heterodimeric variants to allow for heterodimer formation and/or purification away from homodimers. The heterodimeric fusion constructs are based on the self-assembling nature of the two Fc domains, e.g., two "monomers" that assemble into a "dimer".

There are a number of suitable pairs of sets of heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other; that is, these pairs of sets form an interface between the two monomers that encourages heterodimer formation and discourages homodimer formation, allowing the percentage of heterodimers that spontaneously form under biological conditions to be over 90%, rather than the expected 50% (25% homodimer A/A: 50% heterodimer A/B:25% homodimer B/B).

B. Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are included in the FIG. 29 of U.S. Ser. No. 15/141,350, all of which is hereby incorporated by reference in its entirety, as well as in FIG. 5.

One mechanism is generally referred to in the art as "knobs and holes", referring to amino acid engineering that creates steric influences to favor heterodimeric formation and disfavor homodimeric formation, as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The Figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem.

285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g., these are "monomer" corresponding sets) and C220E/P228E/368E paired with C220R/E224R/P228R/K409R.

Additional monomer A and monomer B variants can be combined with other variants, optionally and independently in any amount, such as pI variants outlined herein or other steric variants that are shown in FIG. 37 of US 2012/0149876, all of which are incorporated expressly by reference herein.

In some embodiments, the steric variants outlined herein can be optionally and independently incorporated with any pI variant (or other variants such as Fc variants, FcRn variants, etc.) into one or both monomers, and can be independently and optionally included or excluded from the proteins of the invention.

A list of suitable skew variants is found in FIG. 5. Of particular use in many embodiments are the pairs of sets including, but not limited to, S364K/E357Q:L368D/K370S; L368D/K370S:S364K; L368E/K370S:S364K; T411T/E360E/Q362E:D401K; L368D/K370S:S 364K/E357L; K370S:S364K/E357Q; and T366S/L368A/Y407V:T366W (optionally including a bridging disulfide, T366S/L368A/Y407V/Y349C:T366W/S354C). In terms of nomenclature, the pair "S364K/E357Q:L368D/K370S" means that one of the monomers has the double variant set S364K/E357Q and the other has the double variant set L368D/K370S; as above, the "strandedness" of these pairs depends on the starting pI.

C. pI (Isoelectric Point) Variants for Heterodimers

In general, as will be appreciated by those in the art, there are two general categories of pI variants: those that increase the pI of the protein (basic changes) and those that decrease the pI of the protein (acidic changes). As described herein, all combinations of these variants can be used: one monomer may be wild type, or a variant that does not display a significantly different pI from wild-type, and the other can be either more basic or more acidic. Alternatively, each monomer may be changed, one to more basic and one to more acidic.

Preferred combinations of pI variants are shown in FIG. 30 of U.S. Ser. No. 15/141,350, all of which are herein incorporated by reference in its entirety. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, a preferred combination of pI variants has one monomer comprising 208D/295E/384D/418E/421D variants (N208D/Q295E/N384D/Q418E/N421D when relative to human IgG1) if one of the Fc monomers includes a CH1 domain. In some instances, the second monomer comprising a positively charged domain linker, including (GKPGS)₄ (SEQ ID NO: 38). In some cases, the first monomer includes a CH1 domain, including position 208. Accordingly, in constructs that do not include a CH1 domain (for example for heterodimeric Fc fusion proteins that do not utilize a CH1 domain on one of the domains), a preferred negative pI variant Fc set includes 295E/384D/418E/421D variants (Q295E/N384D/Q418E/N421D when relative to human IgG1).

In some embodiments, mutations are made in the hinge of the Fc domain, including positions 216, 217, 218, 219, 220, 221, 222, 223, 224, 225, 226, 227, 228, 229, and 230. Thus, pI mutations and particularly substitutions can be made in one or more of positions 216-230, with 1, 2, 3, 4 or 5 mutations finding use in the present invention. Again, all possible combinations are contemplated, alone or with other pI variants in other domains.

Specific substitutions that find use in lowering the pI of hinge domains include, but are not limited to, a deletion at position 221, a non-native valine or threonine at position 222, a deletion at position 223, a non-native glutamic acid at position 224, a deletion at position 225, a deletion at position 235 and a deletion or a non-native alanine at position 236. In some cases, only pI substitutions are done in the hinge domain, and in others, these substitution(s) are added to other pI variants in other domains in any combination.

In some embodiments, mutations can be made in the CH2 region, including positions 233, 234, 235, 236, 274, 296, 300, 309, 320, 322, 326, 327, 334 and 339. It should be noted that changes in 233-236 can be made to increase effector function (along with 327A) in the IgG2 backbone. Again, all possible combinations of these 14 positions can be made; e.g., a pI antibody may have 1, 2, 3, 4, 5, 6, 7, 8, 9 or 10 CH2 pI substitutions.

Specific substitutions that find use in lowering the pI of CH2 domains include, but are not limited to, a non-native glutamine or glutamic acid at position 274, a non-native phenylalanine at position 296, a non-native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non-native threonine at position 339, and all possible combinations within CH2 and with other domains.

In this embodiment, the mutations can be independently and optionally selected from position 355, 359, 362, 384, 389, 392, 397, 418, 419, 444 and 447. Specific substitutions that find use in lowering the pI of CH3 domains include, but are not limited to, a non-native glutamine or glutamic acid at position 355, a non-native serine at position 384, a non-native asparagine or glutamic acid at position 392, a non-native methionine at position 397, a non-native glutamic acid at position 419, a non-native glutamic acid at position 359, a non-native glutamic acid at position 362, a non-native glutamic acid at position 389, a non-native glutamic acid at position 418, a non-native glutamic acid at position 444, and a deletion or non-native aspartic acid at position 447.

D. Isotypic Variants

In addition, many embodiments of the invention rely on the "importation" of pI amino acids at particular positions from one IgG isotype into another, thus reducing or eliminating the possibility of unwanted immunogenicity being introduced into the variants. A number of these are shown in FIG. 21 of US Publ. App. No. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significantly affect the pI of the variant Fc fusion protein. However, it should be noted as discussed below that even changes in IgG2 molecules allow for increased serum half-life.

In other embodiments, non-isotypic amino acid changes are made, either to reduce the overall charge state of the resulting protein (e.g., by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

E. Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Publ. App. No. 2014/0370013. As discussed herein, which monomer to engineer is generally decided by the inherent pI of each monomer.

F. pI Variants that Also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall' Acqua et al. showed that Fc mutants with increased FcRn binding at pH 6 and pH 7.4 actually had reduced serum concentrations and the same half-life as wild-type Fc (Dall' Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

G. Additional Fc Variants for Additional Functionality

In addition to pI amino acid variants, there are a number of useful Fc amino acid modification that can be made for a variety of reasons, including, but not limited to, altering binding to one or more FcγR, altered binding to FcRn, etc.

Accordingly, the proteins of the invention can include amino acid modifications, including the heterodimerization variants outlined herein, which includes the pI variants and steric variants. Each set of variants can be independently and optionally included or excluded from any particular heterodimeric protein.

H. FcγR Variants

Accordingly, there are a number of useful Fc substitutions that can be made to alter binding to one or more of the Fcγ receptors. Substitutions that result in increased binding as well as decreased binding can be useful. For example, it is known that increased binding to FcγRIIIa results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), U.S. Ser. Nos. 11/174,287, 11/396,495, 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T.

In addition, amino acid substitutions that increase affinity for FcγRIIc can also be included in the Fc domain variants outlined herein. The substitutions described in, for example, U.S. Ser. Nos. 11/124,620 and 14/578,305 are useful.

In addition, there are additional Fc substitutions that find use in increased binding to the FcRn and increased serum half-life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I or V/434S, 436V/428L and 259I/308F/428L.

I. Ablation Variants

Similarly, another category of functional variants are "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g., FcγR1, FcγRIIa, FcγRIIb, FcγRIIIa, etc.) to avoid additional mechanisms of action. That is, for example, in many embodiments, particularly in the use of immunomodulatory proteins, it is desirable to ablate FcγRIIIa binding to eliminate or significantly reduce ADCC activity such that one of the Fc domains comprises one or more Fcγ receptor ablation variants. These ablation variants are depicted in FIG. 31 of U.S. Ser. No. 15/141,350, all of which are herein incorporated by reference in its entirety, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to the EU index. In addition, ablation variants of use in the present invention are also depicted in FIG. 7. It should be noted that the ablation variants referenced herein ablate FcγR binding but generally not FcRn binding.

J. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

In addition, any of the heterodimerization variants, skew and pI, may also be independently and optionally combined with Fc ablation variants, Fc variants, FcRn variants, as generally outlined herein.

In addition, a monomeric Fc domain can comprise a set of amino acid substitutions that includes C220S/S267K/L368D/K370S or C220S/S267K/S364K/E357Q.

In addition, the heterodimeric Fc fusion proteins can comprise skew variants (e.g., a set of amino acid substitutions as shown in FIGS. 1A-1C of U.S. Ser. No. 15/141,350, all of which are herein incorporated by reference in its entirety), with particularly useful skew variants being selected from the group consisting of S364K/E357Q: L368D/K370S; L368D/K370S:S364K; L368E/K370S: S364K; T411T/E360E/Q362E:D401K; L368D/K370S: S364K/E357L; K370S:S 364K/E357Q; T366S/L368A/Y407V:T366W; and T366S/L368A/Y407V:T366W (optionally including a bridging disulfide, T366S/L368A/Y407V/Y349C:T366W/S354C), optionally ablation variants, optionally charged domain linkers; and optionally pI variants.

In some embodiments, the Fc domain comprises one or more amino acid substitutions selected from the group consisting of: 236R, S239D, S239E, F243L, M252Y, V259I, S267D, S267E, S67K, S298A, V308F, L328F, L328R, 330L, I332D, 1332E, M428L, N434A, N434S, 236R/L328R, S239D/I332E, 236R/L328F, V259I/V308F, S267E/L328F, M428L/N43S, Y436I/M428L, N436V/M428L, V436I/N434S, Y436V/N434S, S239D/I332E/330L, M252Y/S54T/T256E, V259I/V308F/M428L, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K according to EU index.

In one embodiment, a particular combination of skew and pI variants that finds use in the present invention is T366S/L368A/Y407V:T366W (optionally including a bridging disulfide, T366S/L368A/Y407V/Y349C:T366W/S354C) with one monomer comprising Q295E/N384D/Q418E/N481D and the other a positively charged domain linker. As will be appreciated in the art, the "knobs in holes" variants do not change pI, and thus can be used on either monomer.

In a further embodiment, the heterodimers of the present invention include a combination of heterodimeric and Fc domain variants such as those depicted in the figures.

In some embodiments, exemplary CH1 and partial hinge regions are used to covalently link a variable domain to the Fc backbones for targeted IL-10 fusion proteins of the present invention. Such sequences are provided in FIG. 12 and the sequence listing for the corresponding SEQ ID NOS.

In some embodiments, the Fc domains of any of the untargeted and targeted IL-10 fusion proteins provided herein comprise modifications promoting heterodimerization of Fc domains. In some embodiments, the modifications promoting heterodimerization are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q and T366S/L368A/Y407V:T366W (optionally including a bridging disulfide, T366S/L368A/Y407V/Y349C:T366W/S354C), according to EU numbering. In some embodiments, the Fc domains have an additional set of amino acid substitutions comprising Q295E/N384D/Q418E/N421D, according to EU numbering. In some embodiments, the Fc domains have an additional set of amino acid substitutions consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering. In some embodiments, the Fc domain comprise a further amino acid substitution selected from the group consisting of M428L, N434S, and M428L/N434S, according to EU numbering. Additional modifications are provided in the figures include FIGS. 5A-11C.

III. Interleukin 10

The present invention relates to the biologically functional form of interleukin 10. As stated above, the biologically functional form of interleukin 10 (or "IL-10" or "IL10") is a domain-swapped homodimer formed by non-covalent interactions between two IL-10 monomers (also referred to herein as "IL-10 monomer domains"). The biologically functional IL-10 dimer binds the IL-10 receptor which consists of two alpha and two beta subunits (or R1 and R2 subunits). Notably, the IL-10 dimer becomes biologically inactive upon disruption of the interaction between the individual IL-10 monomers. Different formats of IL-10 monomer domains can be used in accordance with the Fc fusion proteins described in further detail herein. Some exemplary formats are pictured in FIG. 14. Each monomer may contain two domains: (i) the (A-D) domain (FIG. 14A), which comprises residues 1-116 of the mature form of the human IL-10 protein, and (ii) the (E-F) domain (FIG. 14B), which comprises residues 117-160-of the mature form of the human IL-10 protein. As discussed above, the biologically active IL-10 comprises a domain swapped homodimer, which is schematically illustrated in FIG. 14C. Another format of use in the present invention is a single-chain IL-10 complex or "scIL-10" comprising a first IL-10 monomer covalently attached to a second IL-10 monomer, optionally via a linker (see FIG. 14D). Another format of IL-10 of use in the present invention is illustrated in FIG. 14E, which depicts the monomeric IL-10 or "IL10M1" described in for example Josephson et al. (2000), which is hereby incorporated by reference in its entirety and in particular for all teachings related to IL10M1, which is generated by engineering a domain linker between hIL-10(A-D) (e.g., the A-D domain of an IL-10 monomer) and hIL-10(E-F) (e.g., the E-F domain of an IL-10 monomer). Another format of IL-10 of use in the present invention is a split IL-10 format that comprises an hIL-10(A-D) domain non-covalently attached to an hIL-10(E-F) domain, as depicted in FIG. 14F.

In some embodiments, the human IL-10 protein has the amino acid sequence set forth in NCBI Ref. Seq. No. NP_000563.1, SEQ ID NO:1 (human IL-10 (109H) precursor sequence), SEQ ID NO:2 (human IL-10 (109L) precursor sequence), SEQ ID NO:3 (human IL-10 (109H) mature form sequence), SEQ ID NO:4 (human IL-10 (109L) mature form sequence), all as depicted in FIG. 1. As will be appreciated, the IL-10 proteins of use in the present invention may include a histidine at position 109 (109H) or in other embodiments a leucine at position 109 (109L). In some embodiments, the IL-10 monomer domain sequence has at least at least 90%, e.g., 90%, 91%, 92%, 93%, 94%, 95%, 96%, 97%, 98%, 99%, or more sequence identity to SEQ ID NO:1 (human IL-10 (109H) precursor sequence), SEQ ID NO:2 (human IL-10 (109L) precursor sequence), SEQ ID NO:3 (human IL-10 (109H) mature form sequence), SEQ ID NO:4 (human IL-10 (109L) mature form sequence), all as depicted in FIG. 1. The IL-10 monomer domain of the Fc fusion protein can further have 1, 2, 3, 4, 5, 6, 7, 8 or 9 amino acid mutations in the amino acid sequences depicted in FIG. 1. Further exemplary sequences for IL-10 components and configurations of use in the present invention are provided in the figures including FIGS. 15A-15D, 21A-21C, 22, 35A-35D, 36A-36E, 39A-39G, 40A-40M, 41A-41F, 48, 49A-49B, 53, 55, 56A-56C, 57, 58, 59A-59H, 60, 64, 65A-65B, 66A-66D, 67, 68, 69, 70A-70B, 71A-71E, 73, 4A-74B, 75A-75B, 76A-76D, 78A-78G, 79A-79G, and 86A-86D, and in the sequence listing for the corresponding sequence identifiers.

The present invention also provides variant IL-10 monomer domains. These variants find use as part of the biologically functional IL-10 complex as well as any of the IL-10-Fc fusions described herein.

A. Expression Variants

The IL-10 monomer domains subunits of the invention can in some embodiments include variants to improve/increase expression, particularly for the heterodimer formats. Such variants may include variants that reduce or remove potential for deamidation, reduce or remove potential for aspartic acid isomerization, reduce or remove potential for degradation-related PTMs, reduce or remove potential degradation sites, reduce/remove disulfide bridges, and/or reduce or remove potential N-glycosylation sites. Exemplary sequences for IL-10 components and expression variants of use in the present invention are provided in the figures including FIGS. 15A-15D, 21A-21C, 22, 35A-35D, 36A-36E, 39A-39G, 40A-40M, 41A-41F, 48, 49A-49B, 53, 55, 56A-56C, 57, 58, 59A-59H, 60, 64, 65A-65B, 66A-66D, 67, 68, 69, 70A-70B, 71A-71E, 73, 4A-74B, 75A-75B, 76A-76D, 78A-78G, 79A-79G, and 86A-86D, and in the sequence listing for the corresponding sequence identifiers.

As will be appreciated, different formats of the IL-10 Fc fusion proteins of the invention will contain different amino acid modifications and combinations of amino acid modifications to fulfill the above described functions and thereby improve/increase expression of proteins of the invention. Exemplary embodiments of different variant sequences for different formats of Fc fusion proteins of the invention are depicted in FIGS. 15A-15D, 21A-21C, 22, 35A-35D, 36A-36E, 39A-39G, 40A-40M, 41A-41F, 48, 49A-49B, 53, 55, 56A-56C, 57, 58, 59A-59H, 60, 64, 65A-65B, 66A-66D, 67, 68, 69, 70A-70B, 71A-71E, 73, 4A-74B, 75A-75B, 76A-76D, 78A-78G, 79A-79G, and 86A-86D, and in the sequence listing for the corresponding sequence identifiers.

B. Affinity Variants

The invention provides IL-10 variants which form biologically functional IL-10 with altered, that is either reduced or increased, binding affinity for IL-10 receptors. Such variants may also or instead show altered (reduced or increased) potency.

Suitable sites on IL-10 at which amino acid modifications can be introduced include N21, D28, Q38, M39, D41, Q42, L43, D44, N45, I87, E142, D144, and E151 (numbered according to the human IL-10 (IL-10 mature form sequence as depicted in FIG. 1, with either the 109H or 109L sequence). Illustrative modifications at these sites include N21D, D28N, Q38E, M39T, D41N, Q42E, L43V, D44N, N45D, I87A, E142Q, D144N, and E151Q. In some embodiments, the IL-10 variants comprise one or more substitutions selected from the group consisting of N21, D28, Q38, D41, D44, Q42, N45, E142, D144, and E151 (numbered according to human IL-10 mature form sequence, as depicted in FIG. 1). In some embodiments, the IL-10 variants comprise one or more substitutions selected from the group consisting of N21D, D28N, Q38E, D41N, Q42E, D44N, N45D, E142Q, D144N, and E151Q (numbered according to human IL-10 mature form sequence, as depicted in FIG. 1). In some embodiments, the IL-10 variants further comprise one or more substitutions selected from the group consisting of M39, L43, and I87. In some instances, the substitutions include M39T, L43V, I87A, and any combination thereof. IL-10 affinity/potency variants can include modifications at one or more of these sites. In further embodiments, one or more amino acid modifications for altering affinity and/or potency can be combined with one or more additional modifications, including expression variants. These modifications can be used alone or in combination with any other IL-10 variants, such as variants to modulate affinity/potency, introduce/remove disulfide bridges, improve yield, remove charge variants, remove glycosylation sites, and/or improve stability.

Exemplary combinations of affinity/potency variants of use in the present invention include Q38E/D41N, Q38E/Q42E, Q38E/N45D, Q38E/E142Q, Q38E/D144N, D41N/Q42E, D41N/N45D, D41N/E142Q, D41N/D144N, Q42E/N45D, Q42E/E142Q, Q42E/D144N, N45D/E142Q, N45D/D144N, E142Q/D144N, N21D/Q42E, N21D/N45D, N21D/E151Q, Q42E/E151Q, N45D/E151Q, N21D/Q42E/N45D, N21D/Q42E/E151Q, Q42E/N45D/E151Q, N21D/Q42E/N45E, and N21D/Q42E/N45D/E151Q.

In some embodiments, the IL-10 variant of any of the formats of the present invention comprises any of the following substitutions selected from the group consisting of Q38E/Q198E, D41N/D201N, Q42E/Q202E, N45D/N205D, E142Q/E302Q, E142Q/E302Q, D144N/D304N, Q38E/D41N/Q198E/D201N, Q38E/Q42E/Q198E/Q202E, Q38E/N45D/Q198E/N205D, Q38E/E142Q/Q198E/E302Q, Q38E/D144N/Q198E/D304N, D41N/Q42E/D201N/Q202E, D41N/N45D/D201N/N205D, D41N/E142Q/D201N/E302Q, D41N/D144N/D201N/D304N, Q42E/N45D/Q202E/N205D, Q42E/E142Q/Q202E/E302Q, Q42E/D144N/Q202E/D304N, N45D/E142Q/N205D/E302Q, N45D/D144N/N205D/D304N, E142Q/D144N/E302Q/D304N, N21D/N181D, E151Q/E311Q, N21D/Q42E/N181D/Q202E, N21D/N45D/N181D/N205E, N21D/N45D/N181D/N205D, N21D/E151Q/N181D/E311Q, Q42E/E151Q/E311Q, N45D/E151Q/N205D/E311Q, N21D/Q42E/N45D/N181D/Q202E/N205E, N21D/Q42E/E151Q/N181D/Q202E/E311Q, Q42E/N45D/E151Q/Q202E/N205D/E311Q, N21D/Q42E/N45D/E151Q/N181D/Q202E/N205D/E311Q, Q38E/N45D/N205D, D41N/N45D/N205D, N45D/D144N/N205D, N205D, N45D, N21D/N45D/N205D, N45D/N181D/N205D, N45D/E151Q/N205D, N45D/N205D/E311Q, and N45D/N205D/D304N.

In some embodiments, the IL-10 variant of any of the formats of the present invention comprises any of the following substitutions selected from the group consisting of N10A, N10Q, N92A, N126A, N160A, N10A/N45D/N170A/N205D, N45D/N92A/N205D/N252A, N45D/N126A/N205D/N286A, N45D/N160A/N205D, N45D/N205D/N320A, N45D/N160A/N205D/N320A, N10A/N45D/N170A/N205D/N320A, N10A/N45D/N170A/N205D/N320_, N10A/N45D/N170A/N205D/R319_/N320_, N10A/N45D/N170A/N205D/I318_/R319_/N320_, N10A/N45D/N170A/N205D/K317_/I318_/R319_/N320_, N10A/N45D/N205D/N320A, N45D/N170A/N205D/N320A, N10Q/N45D/N170Q/N205D/N320A, D28A, and D28A/N45D/D188A/N205D. In some embodiments, the scIL10 variant comprises any of the following substitutions selected from the group consisting of N10A, N92A, N126A, N160A, N170A, N170Q, N252A, N286A, N320A, K317_, I318_, R319_, N320_, and any combination thereof. In some embodiments, the substitution(s) reduces the potential for deamidation of the fusion protein.

In some embodiments, the IL-10 variant of any of the formats of the present invention comprises any of the following substitutions selected from the group consisting of D28A and D28A/N45D/D188A/N205D. In some embodiments, the substitution(s) reduces the potential for aspartic acid isomerization.

In some embodiments, the IL-10 variant of any of the formats of the present invention comprises any of the following substitutions selected from the group consisting of N116D, N116Q, K117P, S118A, N45D/N116D/N205D, N45D/N116D/N205D, N45D/K117P/N205D, N45D/S118A/N205D, N45D/N205D/N276D, N45D/N205D/N276Q, N45D/N205D/K277P, N45D/N205D/S178A, and N45D/N116D/N205D/N276D. In some embodiments, the substitution reduces N-glycosylation sites.

In some embodiments, the IL-10 variant of any of the formats of the present invention comprises any of the following substitutions selected from the group consisting of C12A/C108A and C12A/N45D/C108A/C172A/N205D/C268A/N320A. In some embodiments, the substitution(s) reduces the potential for the formation of disulfide bridges.

In some embodiments, the IL-10 variant of any of the formats of the present invention comprises any of the following substitutions selected from the group consisting F37C/M140C, Q38C/S141C, D41C/K138C, L47C/K138C, L48C/E142C, S51C/A120C, D55C/A120C, F56C/Y153C, C62A/C114A, A64C/S118C, M68C/V121C, and V76C/A139C. In some embodiments, the IL10M1 variant comprises one or more cysteine substitution(s) at the following residues: F37, Q38, D41, L47, L48, S51, D55, F56, A64, M68, and V76 in helices A-D; and S118, A120, V121, K138, A139, M140, S141, E142, and Y153 in helices E-F. In some instances, disulfide bridges between the following amino acid pairs is found in an IL10M1 variants: F37C:M140C, Q38C:S141C, D41C:K 138C, L47C:K138C, L48C: E142C, S51C: A120C, D55C: A120C, F56C: Y153C, A64C:S118C, M68C: V121C, and V76C: A139C to promote stabilization of the interaction between helices A-D and helices E-F. In some embodiments, the substitution(s) allows for the formation of disulfide bridges.

In some embodiments, the IL-10 variant of any of the formats of the present invention comprises any of the following substitutions selected from the group consisting L47Q, S118A, and A139Q. In some embodiments, the IL-10 variant of any of the formats comprises any of the following substitutions selected from the group consisting L19, L23, L26, A29, F30, V33, F37, L47, L48, L52, F56, A64, L65, S66, M68, I69, F71, Y72, V76, M77, A80, E81, I87, V91, L94, G95, L98, L101, L105, L112, S118, V121, V124, F128, K138, A139, M140, S141, F143, F146, I147, and I150.

Exemplary sequences for IL-10 components and affinity variants of use in the present invention are provided in the figures including FIGS. 15A-15D, 21A-21C, 22, 35A-35D, 36A-36E, 39A-39G, 40A-40M, 41A-41F, 48, 49A-49B, 53, 55, 56A-56C, 57, 58, 59A-59H, 60, 64, 65A-65B, 66A-66D, 67, 68, 69, 70A-70B, 71A-71E, 73, 4A-74B, 75A-75B, 76A-76D, 78A-78G, 79A-79G, and 86A-86D, and in the sequence listing for the corresponding sequence identifiers.

A biologically functional IL-10 dimer can comprise two wild-type IL-10 monomers or a variant IL-10 monomer and a wild-type IL-10 monomer.

IV. Antigen Binding Domains

As is discussed below, the term "antibody" or "antigen binding domain" is used generally. Antigen binding domains that find use in the present invention can take on a number of formats as described herein, including traditional antibodies as well as antibody derivatives, fragments and mimetics, described herein and depicted in the Figures. In some embodiments, the present invention provides antibody fusion proteins containing a checkpoint antigen binding domain and an Fc domain. In some embodiments, the present invention provides antibody fusion proteins containing an immune cell antigen binding domain and an Fc domain.

Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to antibodies or antibody fragments (antibody monomers) that generally are based on the IgG class, which has several subclasses, including, but not limited to IgG1, IgG2, IgG3, and IgG4. In general, IgG1, IgG2 and IgG4 are used more frequently than IgG3. It should be noted that IgG1 has different allotypes with polymorphisms at 356 (D or E) and 358 (L or M). The sequences depicted herein use the 356D/358M allotype, however the other allotype is included herein. That is, any sequence inclusive of an IgG1 Fc domain included herein can have 356E/358L replacing the 356D/358M allotype.

In addition, many of the sequences herein have at least one the cysteines at position 220 replaced by a serine; generally this is the on the "scFv monomer" side for most of the sequences depicted herein, although it can also be on the "Fab monomer" side, or both, to reduce disulfide formation. Specifically included within the sequences herein are one or both of these cysteines replaced (C220S).

The PD-1 antigen binding domain (ABD) (e.g., the anti-PD-1 component) of the targeted IL-10 Fc fusion protein is generally a set of 6 CDRs and/or a variable heavy domain and a variable light domain that form an Fv domain that can bind human PD-1. As shown herein, the anti-PD-1 ABD can be in the form of a scFv, wherein the vh and vl domains are joined using an scFv linker, which can be optionally a charged scFv linker. As will be appreciated by those in the art, the scFv can be assembled from N- to C-terminus as N-vh-scFv linker-vl-C or as N-vl-scFv linker-vh-C, with the C terminus of the scFv domain generally being linked to the hinge-CH2-CH3 Fc domain. Suitable Fvs (including CDR sets and variable heavy/variable light domains) can be used in scFv formats or Fab formats are shown in the Figures as well as disclosed in WO2017/218707 and PCT/US2018/059887 filed Nov. 8, 2018, hereby expressly incorporated in their entirety, and specifically for Figures, Legends, and SEQ identifiers that depict anti-PD-1 sequences.

In some embodiments, PD-1 ABDs are based on the 1C11 clone, shown in the Figures. In some embodiments, PD-1 ABDs of the present invention are based on a variant heavy chain based on the heavy chain of 1C11 clone shown in FIGS. 100A-100B and a variant light chain based on the light chain of 1C11 clone shown in FIGS. 100A-100B. In some embodiments, a PD-1 ABD comprises a variant heavy chain and light chain pair selected from the group consisting of one depicted in FIGS. 100A-100G and the corresponding SEQ ID NOS including 1C11[PD-1]_H0L0, 1C11[PD-1]_H3L3, 1C11[PD-1]_H3.240_L3.148, 1C11[PD-1]_H3.241_L3.148, 1C11[PD-1]_H3.234_L3.144, 1C11[PD-1]_ H3.241_L3.92, 1C11[PD-1]_H3.303_L3.152, 1C11_H3.329_L3.220, 1C11_H3.328_L3.152, pembrolizumab VH and VL chains, nivolumab VH and VL chains, pidilizumab VH and VL chains, MK-3475 VH and VL chains, BAP049 Clone E VH and VL chains, BAP049 Clone B VH and VL chains, H7798N VH and VL chains, h1H3 Var 6 VH and VL chains, APE2058 VH and VL chains, H005-1 VH and VL chains, 317-4B6, 326-4A3 VH and VL chains, hPD-1 mAb 7 (1.2) VH and VL chains, Clone 38[PD-1] VH and VL chains, Clone 39[PD-1] VH and VL chains, Clone 41[PD-1] VH and VL chains, Clone 48[PD-1] VH and VL chains, PD1-17[PD-1] VH and VL chains, PD1-28[PD-1] VH and VL chains, PD1-33[PD-1] VH and VL chains, PD1-35[PD-1] VH and VL chains, LOPD180[PD-1] VH and VL chains, Ab948[PD-1] VH and VL chains, humanized EH-12.2H7 VH and VL chains, RG1H10 VH and VL chains, RG1H10-H2A-22-1S VH and VL chains, RG1H10-H2A-27-25 VH and VL chains, RG1H10-3C VH and VL chains, RG1H10-16C VH and VL chains, RG1H10-17C VH and VL chains, RG1H10-19C VH and VL chains, RG1H10-21C VH and VL chains, RG1H10-23C2 VH and VL chains, mAb7 [PD-1] VH and VL chains, and PD1AB-6[PD-1] VH and VL chains. As will be appreciated by those in the art, the VH and VL domains can be formatted as, Fab or scFvs for use in the PD-1-targeted IL-10 fusion proteins of the invention.

In some embodiments, non-competing PD-1 ABDs are based on the mAb A, mAb B, and mAb C clones, shown in the Figures. In some embodiments, non-competing PD-1 ABDs of the present invention are based on a variant heavy chain based on the heavy chain of the mAb A, mAb B, or mAb C clone shown in FIGS. 104A-104B and a variant light chain based on the light chain of the mAb A, mAb B, or mAb C clone shown in FIGS. 104A-104B. In some embodiments, a non-competing PD-1 ABD comprises a variant heavy chain and light chain pair selected from the group consisting of one depicted in FIGS. 104A-104B and the corresponding SEQ ID NOS including mAb A[PD-1]_H1_l1 and mAb B[PD-1]_H1_L1.

In some embodiments, a non-competing PD-1 ABD comprises a variant heavy chain selected from the group consisting of mAb C[PD-1]_H1, mAb C[PD-1]_H1.19, mAb C[PD-1]_H1.48, mAb C[PD-1]_H1.125, mAb C[PD-1]_H1.130, mAb C[PD-1]_H1.132, mAb C[PD-1]_H1.169, mAb C[PD-1]_H1.175, and mAb C[PD-1]_H2, and a variant light chain selected from the group consisting of mAb C[PD-1]_l1, mAb C[PD-1]_L1.1, mAb C[PD-1]_L1.3, mAb C[PD-1]_L1.45, mAb C[PD-1]_L1.117, mAb C[PD-1]_L1.129, mAb C[PD-1]_L1.135, mAb C[PD-1]_L1.136, mAb C[PD-1]_L1.140, and mAb C[PD-1]_L2. As will be appreciated by those in the art, the VH and VL domains can be formatted as Fab or scFvs for use in the targeted IL-10 fusion proteins of the invention.

In some embodiments, a TIGIT ABD comprises a variant heavy chain selected from the group consisting of 2A5B4 [TIGIT]_H1_L1, 4.1 D3.Q1E(tiragolumab)[TIGIT]_H0_L0, 10A7[TIGIT] VH and VL chains, 1F4[TIGIT], and 4.1D3[TIGIT] VH and VL chains. As will be appreciated by those in the art, the VH and VL domains can be formatted as Fab or scFvs for use in the targeted IL-10 fusion proteins of the invention.

In some embodiments, a TIGIT ABD comprises a variant heavy chain selected from the group consisting of Hu14D7 VH1, Hu14D7 VH2, and Hu14D7 VH3, and a variant light chain selected from the group consisting of Hu14D7 VL1, Hu14D7 VL2, and Hu14D7 VL3. As will be appreciated by those in the art, the VH and VL domains can be formatted as Fab or scFvs for use in the targeted IL-10 fusion proteins of the invention.

In some embodiments, a TIGIT ABD comprises a variant heavy chain selected from the group consisting of Hu26B10 VH1, Hu26B10 VH2, and Hu26B10 VH3, and a variant light chain selected from the group consisting of Hu26B10 VL1, Hu26B10 VL2, and Hu26B10 VL3. As will be appreciated by those in the art, the VH and VL domains can be formatted as Fab or scFvs for use in the targeted IL-10 fusion proteins of the invention.

In some embodiments, a TIGIT ABD comprises a variant heavy chain and light chain pair selected from the group consisting of MEB125.31C6.A1.205 VH4/VL1, MEB125.31C6.A1.205 VH5/VL4, MEB125.31C6.A1.205 VH5/VL3, 15A6 VH and VL chains, 22G2A6 VH and VL chains, 11G11 VH and VL chains, 10D7 VH and VL chains, 10D7 VH and VL chains, 313R19 VH and VL chains, and etigilimab VH and VL chains. As will be appreciated by those in the art, the VH and VL domains can be formatted as Fab or scFvs for use in the targeted IL-10 fusion proteins of the invention.

In some embodiments, an NKG2D ABD comprises a variant heavy chain and light chain pair selected from the group consisting of MS[NKG2D] H0_L0, 1D7B4 [NKG2D]_ H1_L1, KYK-1.0[NKG2D]_H1_L1, KYK-2.0 [NKG2D]_H0_L0, 11B2D10[NKG2D]_H0_L0, 6E5A7 [NKG2D]_H0_L0, 6H7E7[NKG2D]_H0_L0, mAb E[NKG2D]_H1_L1, 16F31[NKG2D]_H1_L1, mAb D[NKG2D]_H1_L1, 1 D7B4[NKG2D]_H1_L1, mAb A[NKG2D]_H1_L1, mAb A[NKG2D]_H1_L2, mAb A[NKG2D]_H2_L1, mAb A[NKG2D]_H2_L2, mAb B[NKG2D]_H1_L1, mAb B[NKG2D]_H1_L1.1, mAb B[NKG2D]_H1_L2, mAb B[NKG2D]_H2_L1, mAb B[NKG2D]_H2_L1.1, mAb B[NKG2D]_H2_L2, mAb B[NKG2D]_H3_L1, mAb B[NKG2D]_H3_L1.1, mAb B[NKG2D]_H3_L2, mAb C[NKG2D]_H1_L1, mAb C[NKG2D]_H1_L2, mAb C[NKG2D]_H2_L1, and mAb C[NKG2D]_H2_L2. As will be appreciated by those in the art, the VH and VL domains can be formatted as Fab or scFvs for use in targeted IL-10 fusion proteins of the invention.

In some embodiments, a CD8 ABD comprises a variant heavy chain and light chain pair selected from the group consisting of OKT8_H2_L1 and 1C11B3[CD8]_H1_L1. As will be appreciated by those in the art, the VH and VL domains can be formatted as Fab or scFvs for use in the targeted IL-10 fusion proteins of the invention.

V. Domain Linkers

In some embodiments, IL-10 monomers and/or IL-10 monomer helix domain (e.g., helices (A-D) and (E-F) are attached together via a linker. Optionally, the monomers and/or monomer helix domain are not attached via a linker. In other embodiments, IL-10 monomers or helix domain are noncovalently attached. In some embodiments, the IL-10 monomer and/or IL-10 monomer helix domain is attached to an Fc domain via a linker. In certain embodiments, IL-10 monomer and/or helix domain is attached to an Fc domain directly, such as without a linker. In some cases, a linker is not used to attach an IL-10 monomer or an IL-10 monomer helix domain to an Fc domain.

In some embodiments, the linker is a "domain linker", used to link any two domains as outlined herein together. While any suitable linker can be used, many embodiments utilize a glycine-serine polymer, including for example $(GS)_n$ (SEQ ID NO: 34), $(GSGGS)_n$ (SEQ ID NO: 35), $(GGGGS)_n$ (SEQ ID NO: 36), and $(GGGS)_n$ (SEQ ID NO: 37), where n is an integer of at least 0 (and generally from 0 to 1 to 2 to 3 to 4 to 5), as well as any peptide sequence that allows for recombinant attachment of the two domains with sufficient length and flexibility to allow each domain to retain its biological function. In certain cases, useful linkers include (GGGGS)₀ ("GGGGS" disclosed as SEQ ID NO: 31) or (GGGGS)₁ (SEQ ID NO: 31) or (GGGGS)₂ (SEQ ID NO: 32). Illustrative domain linkers are depicted in FIG. 103. In some cases, and with attention being paid to "strandedness", as outlined below, charged domain linkers can be used as discussed herein.

VI. Useful Untargeted Formats of the Invention

As shown in FIGS. 16, 20, 23, and 29, there are a number of useful formats of the untargeted IL-10 fusion proteins of the invention. In general, the fusion proteins of the invention have two functional components: an IL-10 dimer component and an Fc component, both of which can take different forms as outlined herein and each of which can be combined with the other component in any configuration. As shown in FIGS. 87, 88, 89, and 90, there are a number of useful formats of the targeted IL-10 fusion proteins of the invention. In general, the fusion proteins of the invention have two functional components: an IL-10 component, an Fc component, and an antigen binding domain, all of which can take different forms as outlined herein and each of which can be combined with the other component in any configuration. As will be appreciated, the IL-10 component in any of the formats described herein may comprise an IL-10 with a histidine at position 109 or a leucine at position 109. The IL-10 component may further include any of the IL-10 monomer variants described herein and known in the art.

In some embodiments, the IL-10 monomers are covalently linked, optionally with a domain linker, and referred to herein as a single-chain IL-10 complex or "scIL-10".

In some embodiments, the IL-10 monomers are not covalently linked, but rather are covalently attached respectively to a first and a second Fc domain which are assembled as a dimer.

In some embodiments, different helices of the IL-10 monomer are attached to each other or to a first and a second Fc domain. In further embodiments, helices (A-D) of an IL-10 monomer are covalently linked to helices (E-F) in a single chain, optionally through a domain linker. In other embodiments, helices (A-D) are covalently attached to a first Fc domain (optionally through a domain linker) and helices (E-F) are covalently attached to a second Fc domain (optionally through a domain linker), such that when the first and second Fc domain associate, the (A-D) helices interact noncovalently with the (E-F) helices. As will be appreciated, in some embodiments, the first and second Fc domains are identical, and in some embodiments the first and second Fc domains are not identical.

The first and/or second Fc domains may have deletions in the Fc region to help enhance manufacturability. In some embodiments, such deletions may include without limitation G446del/K447del.

The first and the second Fc domains can have a set of amino acid substitutions selected from the group consisting of a) L368D/K370S and S364K; b) L368D/K370S and S364K/E357L; c) L368D/K370S and S364K/E357Q; d) T411E/K360E/Q362E and D401K; e) L368E/K370S and S364K; f) K370S and S364K/E357Q; and g) T366S/L368A/Y407V:T366W (optionally including a bridging disulfide, T366S/L368A/Y407V/Y349C:T366W/S354C), according to EU numbering.

In some embodiments, the first and/or the second Fc domains have an additional set of amino acid substitutions comprising Q295E/N384D/Q418E/N421D, according to EU numbering.

Optionally, the first and/or the second Fc domains have an additional set of amino acid substitutions consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

Optionally, the first and/or second Fc domains have 428L/434S variants for half life extension.

As will be appreciated, any of the amino acid substitutions discussed herein, including any of the afore-described substitutions, may be used in any combination with the G445del/K447del modification.

In further preferred embodiments, the formats described herein contain antigen binding domains, where those antigen binding domains target IL-15. In still further embodiments, the antigen binding domains are non-competing PD-1 binding domains.

A. IL10-Fc Fusion Format

Towards engineering an IL-10 fusion protein wherein the IL-10 homodimer is pre-complexed, one embodiment comprises the IL10-Fc fusion format (cartoon schematics depicted in FIG. 16). One such format of this category is the (IL10)₂-Fc format (cartoon schematic depicted in FIG. 16A) which comprises two identical monomers, each monomer comprising an IL-10 monomer covalently attached to the N-terminus of a homodimeric Fc chain. Illustrative proteins of the (IL10)2-Fc format include XENP24628, XENP24629, XENP24630, and XENP24631, sequences for which are depicted in FIG. 17.

Another embodiment is the Fc-(IL10)₂ format (cartoon schematic depicted in FIG. 16B) which comprises two identical monomers, each monomer comprising an IL-10 monomer covalently attached to the C-terminus of a homodimeric Fc chain. Illustrative proteins of the Fc-(IL10)₂ format include XENP24632, XENP24633, and XENP246334, sequences for which are depicted in FIG. 18.

Yet another embodiment is the (IL10-NC-IL10)-heteroFc format (cartoon schematic depicted in FIG. 16C) which comprises a first monomer comprising a first IL-10 monomer covalently attached to the N-terminus of a first heterodimeric Fc chain (optionally via a domain linker) and a second monomer comprising a complementary second heterodimeric Fc chain that is "Fc-only" or "empty-Fc", while a second IL-10 monomer is transfected separately so that a non-covalent IL-10 dimer is formed. Illustrative proteins of the (IL10-NC-IL10)-heteroFc format include XENP25955, sequences for which are depicted in FIG. 19.

In some embodiments, the IL-10 monomers of this format comprise any of the L-10 monomer domains (e.g., the variant IL-10 monomer domain) described herein (e.g., those shown in FIGS. 55, 57, 64, 67, 70A-70B, and 73, the corresponding SEQ ID NOs, and the sequence listing).

B. scIL10-Fc Fusion Format

In another aspect, the present disclosure provides a format that pre-complexes the IL-10 homodimer as a single-chain IL-10 complex (or "scIL-10") wherein a first IL-10 monomer is covalently attached to a second IL-10 monomer. One category of IL-10 fusions utilizing the scIL-10 are referred to herein as scIL10-Fc fusions (cartoon schematics depicted in FIG. 20).

In some embodiments, the scIL-10 of this format comprises an amino acid sequence such as, but not limited, to SEQ ID NO:23 and any of the scIL10 variants described herein (e.g., those shown in FIGS. 21A-21C, 22, 35A-35D, 39A-39G, 40A-40M, 41A-41F, 48, 49A-49B, 53, 55, 56A-56C, 58, 59A-59H, 60, 64, 65A-65B, 66A-66D, 67, 68, 69, 70A-70B, 73, 78A-78G, 79A-79G, and 86A-86D, the corresponding SEQ ID NOS, and the sequence listing). In some embodiments, the scIL-10 component comprises an amino acid sequence having at least 90% (e.g., at least 90%, 91%, 92%, 93%, 94%, 95%, 96%, 97%, 98%, 99%, or more) sequence identity to SEQ ID NO:23.

One embodiment is the scIL10-heteroFc format (cartoon schematic depicted in FIG. 20A), which comprises a first monomer comprising a scIL-10 covalently attached to the N-terminus of a first heterodimeric Fc chain and a second monomer comprising a complementary second heterodimeric Fc chain that is "Fc-only" or "empty-Fc". An illustrative protein of the scIL10-heteroFc format include XENP25238, XENP25239, XENP25240, XENP25241, XENP25880, and XENP28295, sequences for which are depicted in FIGS. 21A-21C and the corresponding SEQ ID NOS in the sequence listing.

In some embodiments, the scIL10-heteroFc fusion proteins comprise the sequences set forth in FIGS. 78A-78G and the sequence listing for XENP30003, XENP30004, XENP30005, XENP30006, XENP30007, XENP30008, XENP30009, XENP30010, XENP30011, XENP30012, XENP30013, XENP30014, and XENP30015. XENP30007 is also referred to as scIL10.104-Fc. XENP30008 is also referred to as scIL10.105-Fc. XENP30010 is also referred to as scIL10.107-Fc.

In some embodiments, the heteroFc-scIL10 fusion proteins comprise the sequences set forth in FIGS. 79A-79G and sequence listing for XENP30016, XENP30017, XENP30018, XENP30019, XENP30020, XENP30021, XENP30022, XENP30023, XENP30024, XENP30025, XENP30026, XENP30027, and XENP30028.

In some embodiments, the scIL10 fusion proteins containing M428L/N434S substitutions in the Fc domains comprise the sequences set forth in FIGS. 86A-86D and the sequence listing for XENP31091, XENP31092, XENP31093, XENP31094, XENP31095, XENP31096, XENP31830, and XENP31831.

Another embodiment is the heteroFc-scIL10 format (cartoon schematic depicted in FIG. 20B), which comprises a first monomer comprising a scIL-10 covalently attached to the C-terminus of a first heterodimeric Fc chain (optionally via a domain linker) and a second monomer comprising a complementary second heterodimeric Fc chain that is "Fc-only" or "empty-Fc". An illustrative protein of the heteroFc-scIL10 is XENP28740, sequences for which are depicted in FIG. 22 and the corresponding SEQ ID NOS in the sequence listing.

In some embodiments, the Fc fusion proteins in this exemplary format comprise the format pictured in FIG. 20A with IL-10 variants and/or amino acid substitutions in the Fc domain. In some embodiments, the Fc fusion proteins in this exemplary format have the sequences set forth in FIG. 21A and the sequence listing for the corresponding sequence identifiers. In some embodiments, the Fc fusion proteins have the sequences set forth in FIGS. 78A-78G and sequence listing for XENP30003, XENP30004, XENP30005, XENP30006, XENP30007, XENP30008, XENP30009, XENP30010, XENP30011, XENP30012, XENP30013, XENP30014, and XENP30015. In further embodiments, the Fc fusion proteins in this exemplary format have the sequences set forth in FIGS. 78A-78G for XENP30005 (SEQ ID NO:25 and SEQ ID NO:26), XENP30008 (SEQ ID NO:27 and SEQ ID NO:28), and XENP30013 (SEQ ID NO:29 and SEQ ID NO:30). In still further embodiments, the Fc fusion proteins in this exemplary format comprise the sequences set forth FIGS. 78A-78G for XENP30005, XENP30008, and XENP30013 with the additional amino acid modifications selected from the group (singly or in any combination): G445del, K447del, G445del/K447del, M428L, N434S, and M428L/N434S, according to EU numbering.

C. IL10M1-Fc Fusion

In another aspect, the present disclosure provides a format engineered with the aim to circumvent the requirement for domain swapping between two IL-10 monomers. As discussed above, disruption of the non-covalent interaction which forms the biologically active IL-10 homodimer results in biologically inactive IL-10 monomers. However, Josephson et al. (2000) reported "IL-10M1" (or "IL10M1"; sequence depicted in FIG. 15D) which is a biologically active IL-10 monomer generated by engineering a Gly-Ser linker (GGGSGG; SEQ ID NO: 39) between helices D and E of an IL-10 monomer. Josephson et al. reported that IL-10M1 is capable of binding IL-10R1 and recruiting IL-10R2 to induce IL-10 cellular responses. Accordingly, in this aspect, the Fc fusion protein utilizes IL10M1, and such a format is referred to herein as IL10M1-Fc fusions (cartoon schematics depicted in FIGS. 23A-23F).

In some embodiments, the IL10M1 of this format comprises an amino acid sequence such as, but not limited to, SEQ ID NO:24 and any of the IL10M1 variants described herein (e.g., those shown in FIGS. 36A-36E, 55, 57, 64, 67, 70A-70B, 71A-71E, 73, 74A-74B, 75A-75B, and 76A-76D, the corresponding SEQ ID NOs, and the sequence listing). In some embodiments, the IL10M1 variants comprises one or more substitutions selected from the group consisting of N21D, D28N, Q38E, M39T, D41N, Q42E, L43V, D44N, N45D, I87A, E142Q, D144N, E151Q, Q38E/D41N, Q38E/Q42E, Q38E/N45D, Q38E/E142Q, Q38E/D144N, D41N/Q42E, D41N/Q42E, D41N/N45D, D41N/E142Q, D41N/D144N, Q42E/N45D, Q42E/E142Q, Q42E/D144N, N45D/E142Q, N45D/D144N, E142Q/D144N, N21D/Q42E, N21D/N45D, N21D/E151Q, N21D/N45E, Q42E/E151Q, N45D/E151Q, N21D/Q42E/N45D, N21D/Q42E/E151Q, Q42E/N45D/E151Q, N21D/Q42E/N45E, and N21D/Q42E/N45D/E151Q. In some embodiments, the IL10M1 component comprises an amino acid sequence having at least 90% (e.g., at least 90%, 91%, 92%, 93%, 94%, 95%, 96%, 97%, 98%, 99%, or more) sequence identity to SEQ ID NO:24.

In some instances, the IL10M1 component of the format comprises an amino acid sequence selected from the group consisting of the sequence depicted in FIGS. 75A-75B and the sequence listing for the corresponding sequence identifiers. In some embodiments, the IL10M1 component comprises a linker (e.g., an insert peptide) selected from the group consisting of PGGSGG (SEQ ID NO: 40), GPGSGG (SEQ ID NO: 41), GGPSGG (SEQ ID NO: 42), GGGPGG (SEQ ID NO: 43), GGGSPG (SEQ ID NO: 44), GGGSGP (SEQ ID NO: 45), GGGGG (SEQ ID NO: 46), GGGG (SEQ ID NO: 47), GGG, GG, G, and GGGGSGGGS (SEQ ID NO: 32).

In one embodiment, the (IL10M1)$_1$-heteroFc (cartoon schematic depicted in FIG. 23E) comprises an IL10M1 covalently attached to the N-terminus of a first heterodimeric Fc chain (optionally via a linker), and a second monomer comprising a complementary second heterodimeric Fc chain that is "Fc-only" or "empty-Fc". An illustrative protein of the (IL10M1)1-heteroFc format is XENP14246, sequences for which are depicted in FIG. 24.

In another embodiment, the heteroFc-(IL10M1)$_1$ format (cartoon schematic depicted in FIG. 23F) comprises an IL10M1 covalently attached to the C-terminus of a first heterodimeric Fc chain (optionally via a linker), and a second monomer comprising a complementary second heterodimeric Fc chain that is "Fc-only" or "empty-Fc". An illustrative protein of the heteroFc-(IL10M1)1 format is XENP14247, sequences for which are depicted in FIG. 25 and the corresponding SEQ ID NOS in the sequence listing. In some embodiments, the (IL10M1)$_1$-heteroFc fusion proteins comprise the sequences set forth in FIGS. 37A-37E and the sequence listing for XENP25753, XENP25754, XENP25755, XENP25756, XENP25757, XENP25758, XENP25759, XENP25760, XENP25761, XENP25763, XENP25766, XENP25767, and XENP25768 and the corresponding sequence identifiers.

In yet another embodiment, the (IL10M1)$_2$-Fc format (cartoon schematic depicted in FIG. 23A) comprises two identical monomers, wherein each monomer comprising an IL10M1 covalently attached to the N-terminus of a homodimeric Fc chain. An illustrative protein of the (IL10M1)$_2$-Fc format is XENP25236, sequences for which are depicted in FIG. 26. In a further embodiment, the Fc-(IL10M1)$_2$ format (cartoon schematic depicted in FIG. 23B) comprises two identical monomers, wherein each monomer comprising an IL10M1 covalently attached to the C-terminus of a homodimeric Fc chain. An illustrative protein of the Fc-(IL10M1)$_2$ format is XENP25237, sequences for which are depicted in FIG. 27 and the corresponding SEQ ID NOS in the sequence listing.

In a further embodiment, the (IL10M1)$_2$-heteroFc format (cartoon schematic depicted in FIG. 23C) comprises a first monomer comprising a first IL10M1 covalently attached to a second IL10M1 (optionally via a linker) further covalently attached to the N-terminus of a first heterodimeric Fc chain (optionally via a linker), and a second monomer comprising a complementary second heterodimeric Fc chain that is "Fc-only" or "empty-Fc". An illustrative protein of the (IL10M1)$_2$-heteroFc format is XENP26887, sequences for which are depicted in FIG. 28 and the corresponding SEQ ID NOS in the sequence listing.

D. splitIL10-Fc Fusion

In another aspect, instead of utilizing a Gly-Ser linker between IL10(A-D) and IL10(E-F) domains as in IL10M1, a biologically active IL-10 monomer was generated by "splitting" the IL-10 monomer into its two domains (i.e. hIL-10(A-D) and hIL-10(E-F), sequences for which are depicted respectively in FIGS. 15A-15B and SEQ ID NO:21 and SEQ ID NO:22), and that dimerization of the IL-10 domains would provide for a biologically active molecule referred to herein as a "splitIL10". Accordingly, the present disclosure provides formats referred to herein as splitIL10-Fc fusions (cartoon schematics depicted in FIGS. 29A-29D).

In some embodiments, the hIL-10(A-D) and hIL-10(E-F) domains of this format comprise amino acid sequences such as, but not limited to SEQ ID NO:21 and SEQ ID NO:22, respectively and any of the hIL-10(A-D) and hIL-10(E-F) domain variants described herein (e.g., those shown in FIGS. 55, 57, 64, 67, 70A-70B, and 73, the corresponding SEQ ID NOS, and the sequence listing).

One embodiment is the splitIL10-heteroFc format (cartoon schematic depicted in FIG. 29A), which comprises a first monomer comprising hIL-10(A-D) covalently attached to the N-terminus of a first heterodimeric Fc chain and a second monomer comprising hIL-10(E-F) covalently attached to the N-terminus of a complementary second heterodimeric Fc chain, so that dimerization of the heterodimeric Fc chains forces dimerization of the IL-10 domains. Illustrative proteins of the splitIL10-heteroFc format include XENP25242, XENP25243, and XENP25244, sequences for which are depicted in FIG. 30 and the corresponding SEQ ID NOS in the sequence listing.

In another embodiment, the heteroFc-splitIL10 format (cartoon schematics depicted in FIG. 29B) comprises a first monomer comprising a hIL-10(A-D) domain covalently attached to the C-terminus of a first heterodimeric Fc chain (optionally via a linker) and a second monomer comprising a hIL-10(E-F) domain covalently attached the C-terminus of a complementary second heterodimeric Fc chain (optionally via a linker). Illustrative proteins of the heteroFc-splitIL10 format include XENP25879, sequences for which are depicted in FIG. 31 and the corresponding SEQ ID NOS in the sequence listing.

VII. Useful Targeted Formats of the Invention

As shown in FIGS. 87, 88, 89, and 90, there are a number of useful formats of the targeted IL-10 fusion proteins of the invention. In general, the fusion proteins of the invention have several components: an IL-10 component, an Fc component, and an antigen binding domain, all of which can take different forms as outlined herein and each of which can be combined with the other component in any configuration. As will be appreciated, the IL-10 component in any of the formats described herein may comprise an IL-10 with a histidine at position 109 or a leucine at position 109. The IL-10 component may further include any of the IL-10 monomer, IL10M1, scIL10, and splitIL10 variants described herein and known in the art. As described above, the Fc domains of such targeted IL-10 fusion proteins include modifications that promote heterodimerization of the Fc domains.

A. Targeted IL10-Fc Fusion Formats

FIG. 87A-FIG. 87D depict illustrative formats for targeted IL-10 fusions based on the IL10-Fc category, herein referred to as the "targeted IL10-Fc" category. FIG. 88A-FIG. 88E depict illustrative formats for targeted IL-10 fusions based on the scIL10-Fc category, herein referred to as the "targeted scIL10-Fc" category. FIG. 89A-FIG. 89M depict illustrative formats for targeted IL-10 fusions based on the IL10M1-Fc category, herein referred to as the "targeted IL10M1-Fc" category. FIG. 90A-FIG. 90H depict illustrative formats for targeted IL-10 fusions based on the splitIL10-Fc category, herein referred to as the "targeted splitIL10-Fc" category.

In some embodiments, targeted IL-10 Fc fusion proteins of the present invention comprise an antigen binding domain such as a Fab or an scFv. In some embodiments, the "mAb-IL10" format (see, e.g., FIG. 87A) comprises two identical monomers, each monomer comprising an antigen-binding domain covalently linked to the N-terminus of a homodimeric Fc chain which is covalently linked via the C-terminus, optionally via a linker, to an IL-10 monomer. In some embodiments, the "IL10-mAb" format (see, e.g., FIG. 87B) comprises two identical monomers, each monomer comprising an IL-10 monomer covalently linked, optionally via a linker, to an antigen-binding domain which is covalently linked to the N-terminus of a homodimeric Fc chain. In some embodiments, the "mAb-central-IL10" format (see, e.g., FIG. 87C) comprises two identical monomers, each monomer comprising an antigen-binding domain covalently linked to an IL-10 monomer which is covalently linked, optionally via a linker, to a homodimeric Fc chain. It should be noted that while the antigen-binding domains are depicted as Fabs, the antigen-binding domain can be any antigen binding molecule as defined herein, such as an scFv. In some embodiments, the "anti-X×IL10-heteroFc" format (see, e.g., FIG. 87D) comprises a first monomer comprising an antigen-binding domain covalently linked to the N-terminus of a first heterodimeric Fc chain and a second monomer comprising a first IL-10 monomer covalently attached to the N-terminus of a second heterodimeric Fc chain (optionally via a domain linker), and a second IL-10 monomer transfected separately so that it forms a non-covalent interaction with the first IL-10 monomer. As will be appreciated, the antigen binding domain for any of the formats described herein, including those illustrated in FIGS. 87A-87D, may be directed to any suitable antigen, including without limitation CD8, NKG2D, PD-1, and TIGIT. In some embodiments, any IL-10 monomer or variant thereof described herein can be used in a targeted IL10-Fc format.

In some embodiments, the CD8 antigen binding domain of the formats described herein comprises the variable heavy chain and variable light chain pairs depicted in FIG. 92 and the sequences of the corresponding SEQ ID NOS in the sequence listing. Non-limiting examples of useful variable heavy chain and variable light chain pairs of a CD8 ABD include OKT8_H2_L1 and 1C11B3_H1_L1.

In some embodiments, the NKG2D antigen binding domain of the formats described herein comprises the variable heavy chain and variable light chain pairs depicted in FIG. 93A-93C and the sequences of the corresponding SEQ ID NOS in the sequence listing. Non-limiting examples of useful variable heavy chain and variable light chain pairs of an NKG2D ABD include MS[NKG2D]_H0_L0, 1D7B4 [NKG2D]_H1_L1, KYK-1.0[NKG2D]_H1_L1, KYK-2.0 [NKG2D]_H0_L0, 11B2D10[NKG2D]_H0_L0, 6E5A7 [NKG2D]_H0_L0, 6H7E7[NKG2D]_H0_L0, mAb E[NKG2D]_H1_L1, 16F31[NKG2D]_H1_L1, mAb D[NKG2D]_H1_L1, 1 D7B4[NKG2D]_H1_L1, mAb A[NKG2D]_H1_L1, mAb A[NKG2D]_H2_L1, mAb A[NKG2D]_H1_L2, mAb A[NKG2D]_H2_L2, mAb B[NKG2D]_H1_L1, mAb B[NKG2D]_H1_L1.1, mAb B[NKG2D]_H1_L2, mAb B[NKG2D]_H2_L1, mAb B[NKG2D]_H2_L1.1, mAb B[NKG2D]_H2_L2, mAb B[NKG2D]_H3_L1, mAb B[NKG2D]_H3_L1.1, mAb B[NKG2D]_H3_L2, mAb C[NKG2D]_H1_L1, mAb C[NKG2D]_H2_L1, mAb C[NKG2D]_H1_L2, and mAb C[NKG2D]_H2_L2.

In some embodiments, the PD-1 antigen binding domain of the formats described herein comprises the variable heavy chain and variable light chain pairs depicted in FIG. 100A-100G and the sequences of the corresponding SEQ ID NOS in the sequence listing. Non-limiting examples of useful variable heavy chain and variable light chain pairs of a PD-1 ABD include 1C11[PD-1]_H0L0, 1C11[PD-1]_H3L3, 1C11 [PD-1]_H3.240_L3.148, 1C11[PD-1]_H3.241_L3.148, 1C11[PD-1]_H3.234_L3.144, 1C11[PD-1]_H3.241_L3.92, 1C11[PD-1]_H3.303_L3.152, 1C11_H3.329_L3.220, 1C11_H3.328_L3.152, pembrolizumab variable heavy chain and variable light chain, nivolumab variable heavy chain and variable light chain, pidilizumab variable heavy chain and variable light chain, MK-3475 variable heavy chain and variable light chain, BAP049 Clone E variable heavy chain and variable light chain, BAP049 Clone B variable heavy chain and variable light chain, H7798N[PD-1] variable heavy chain and variable light chain, h1H3 Var 6[PD-1] variable heavy chain and variable light chain, APE2058[PD-1] variable heavy chain and variable light chain, H005-1[PD-1] variable heavy chain and variable light chain, 317-4B6[PD-1] variable heavy chain and variable light chain, 326-4A3[PD-1] variable heavy chain and variable light chain, hPD-1 mAb 7 (1.2)[PD-1] variable heavy chain and variable light chain, Clone 38[PD-1] variable heavy chain and variable light chain, Clone 39[PD-1] variable heavy chain and variable light chain, Clone 41[PD-1] variable heavy chain and variable light chain, Clone 48[PD-1] variable heavy chain and variable light chain, PD1-17 [PD-1] variable heavy chain and variable light chain, PD1-28[PD-1] variable heavy chain and variable light chain, PD1-33[PD-1] variable heavy chain and variable light chain, PD1-35[PD-1] variable heavy chain and variable light chain, LOPD180 variable heavy chain and variable light chain, Ab948 variable heavy chain and variable light chain, humanized EH-12.2H7[PD-1] variable heavy chain and variable light chain, RG1H10 variable heavy chain and variable light chain, RG1H10-H2A-22-1S variable heavy chain and variable light chain, RG1H10-H2A-27-2S variable heavy chain and variable light chain, RG1H10-3C variable heavy chain and variable light chain, RG1H10-16C variable heavy chain and variable light chain, RG1H10-17C variable heavy chain and variable light chain, RG1H10-19C variable heavy chain and variable light chain, RG1H10-21C variable heavy chain and variable light chain, RG1H10-23C2 variable heavy chain and variable light chain, mAb7 [PD-1], and PD1AB-6[PD-1] variable heavy chain and variable light chain.

In some embodiments, the non-competing PD-1 antigen binding domain of the formats described herein comprises the variable heavy chain and variable light chain pairs depicted in FIG. 104A-104B and the sequences of the corresponding SEQ ID NOS in the sequence listing. Non-limiting examples of useful variable heavy chain and variable light chain pairs of a non-competing PD-1 ABD include mAb A[PD-1]_H1_L1, mAb B[PD-1]_H1_L1, mAb C[PD-1]_H1_L1, mAb C[PD-1]_H1_L1.1, mAb C[PD-1]_ H1_L1.3, mAb C[PD-1]_H1_L1.45, mAb C[PD-1]_ H1_L1.117, mAb C[PD-1]_H1_L1.129, mAb C[PD-1]_ H1_L1.135, mAb C[PD-1]_H1_L1.136, mAb C[PD-1]_ H1_L1.140, mAb C[PD-1]_H1_L2, mAb C[PD-1]_ H1.19_L1, mAb C[PD-1]_H1.19_L1.1, mAb C[PD-1]_ H1.19_L1.3, mAb C[PD-1]_H1.19_L1.45, mAb C[PD-1]_ H1.19_L1.117, mAb C[PD-1]_H1.19_L1.129, mAb C[PD-1]_H1.19_L1.135, mAb C[PD-1]_H1.19_L1.136, mAb C[PD-1]_H1.19_L1.140, mAb C[PD-1]_H1.19_L2, mAb C[PD-1]_H1.48_L1, mAb C[PD-1]_H1.48_L1.1, mAb C[PD-1]_H1.48_L1.3, mAb C[PD-1]_H1.48_L1.45, mAb C[PD-1]_H1.48_L1.117, mAb C[PD-1]_H1.48_L1.129, mAb C[PD-1]_H1.48_L1.135, mAb C[PD-1]_ H1.48_L1.136, mAb C[PD-1]_H1.48_L1.140, mAb C[PD-1]_H1.48_L2, mAb C[PD-1]_H1.125_L1, mAb C[PD-1]_ H1.125_L1.1, mAb C[PD-1]_H1.125_L1.3, mAb C[PD-1]_ H1.125_L1.45, mAb C[PD-1]_H1.125_L1.117, mAb C[PD-1]_H1.125_L1.129, mAb C[PD-1]_ H1.125_L1.135, mAb C[PD-1]_H1.125_L1.136, mAb C[PD-1]_H1.125_L1.140, mAb C[PD-1]_H1.125_L2, mAb C[PD-1]_H1.130_L1, mAb C[PD-1]_H1.130_L1.1, mAb C[PD-1]_H1.130_L1.3, mAb C[PD-1]_H1.130_L1.45, mAb C[PD-1]_ H1.130_L1.117, mAb C[PD-1]_ H1.130_L1.129, mAb C[PD-1]_H1.130_L1.135, mAb C[PD-1]_H1.130_L1.136, mAb C[PD-1]_H1.130_L1.140, mAb C[PD-1]_H1.130_L2, mAb C[PD-1]_H1.132_L1, mAb C[PD-1]_H1.132_L1.1, mAb C[PD-1]_H1.132_L1.3, mAb C[PD-1]_ H1.132_L1.45, mAb C[PD-1]_ H1.132_L1.117, mAb C[PD-1]_H1.132_L1.129, mAb C[PD-1]_H1.132_L1.135, mAb C[PD-1]_ H1.132_L1.136, mAb C[PD-1]_ H1.132_L1.140, mAb C[PD-1]_H1.132_L2, mAb C[PD-1]_H1.169_L1, mAb C[PD-1]_H1.169_L1.1, mAb C[PD-1]_H1.169_L1.3, mAb C[PD-1]_H1.169_L1.45, mAb C[PD-1]_H1.169_L1.117, mAb C[PD-1]_H1.169_L1.129, mAb C[PD-1]_H1.169_L1.135, mAb C[PD-1]_H1.169_L1.136, mAb C[PD-1]_H1.169_L1.140, mAb C[PD-1]_H1.169_L2, mAb C[PD-1]_H1.175_L1, mAb C[PD-1]_H1.175_L1.1, mAb C[PD-1]_H1.175_L1.3, mAb C[PD-1]_H1.175_L1.45, mAb C[PD-1]_H1.175_L1.117, mAb C[PD-1]_H1.175_L1.129, mAb C[PD-1]_H1.175_L1.135, mAb C[PD-1]_H1.175_L1.136, mAb C[PD-1]_H1.175_L1.140, mAb C[PD-1]_H1.175_L2, mAb C[PD-1]_H2_L1, mAb C[PD-1]_H2_L1.1, mAb C[PD-1]_H2_L1.3, mAb C[PD-1]_H2_L1.45, mAb C[PD-1]_H2_L1.117, mAb C[PD-1]_H2_L1.129, mAb C[PD-1]_H2_L1.135, mAb C[PD-1]_H2_L1.136, mAb C[PD-1]_H2_L1.140, and mAb C[PD-1]_H2_L2.

In some embodiments, the TIGIT antigen binding domain of the formats described herein comprises the variable heavy chain and variable light chain pairs depicted in FIG. 122A-122C and the sequences of the corresponding SEQ ID NOS in the sequence listing. Non-limiting examples of useful variable heavy chain and variable light chain pairs of a TIGIT ABD include 2A5B4[TIGIT]_H1_L1, Genentech_4.1 D3.Q1E(tiragolumab)_H0_L0, 10A7 [TIGIT] variable heavy chain and variable light chain, 1F4[TIGIT] variable heavy chain and variable light chain, 4.1D3[TIGIT] variable heavy chain and variable light chain, Hu14D7 VH1_VL1, Hu14D7 VH1_VL2, Hu14D7 VH1_VL3, Hu14D7 VH2_VL1, Hu14D7 VH2_VL2, Hu14D7 VH2_VL3, Hu14D7 VH3_VL1, Hu14D7 VH3_VL2, Hu14D7 VH3_VL3, Hu26B10 VH1_VL1, Hu26B10 VH1_VL2, Hu26B10 VH1_L3, Hu26B10 VH2_VL1, Hu26B10 VH2_VL2, Hu26B10 VH2_VL3, Hu26B10 VH3_VL1, Hu26B10 VH3_L2, Hu26B10 VH3_VL3, MEB125.31C6.A1.205 VH4/VL1, MEB125.31C6.A1.205 VH5/VL4, MEB125.31C6.A1.205 VH5/VL3, 15A6 variable heavy chain and variable light chain, 22G2 variable heavy chain and variable light chain, 11G11 variable heavy chain and variable light chain, 10D7 variable heavy chain and variable light chain, 313R19 variable heavy chain and variable light chain, and etigilimab variable heavy chain and variable light chain.

B. Targeted scIL10-Fc Fusion Formats

In further embodiments, formats such as those pictured in FIG. 88A-FIG. 88E are provided by the present disclosure. FIG. 88 depicts illustrative formats for targeted IL-10 fusions based on the scIL10-Fc category, herein referred to as the "targeted scIL10-Fc" category. In some embodiments, the "anti-X×scIL10-heteroFc" format (see, e.g., FIG. 88A) comprises a first monomer comprising an antigen-binding domain covalently linked to the N-terminus of a first heterodimeric Fc chain and a second monomer comprising a scIL-10 covalently attached to the N-terminus of a second heterodimeric Fc chain (optionally via a domain linker). In some embodiments, the "anti-X× heteroFc-scIL10" format (see, e.g., FIG. 88B) comprises a first monomer comprising an antigen-binding domain covalently linked to the N-terminus of a first heterodimeric Fc chain and a second monomer comprising a second heterodimeric Fc chain covalently linked via the C-terminus to a scIL-10 (optionally via a domain linker). In some embodiments, the "anti-X× heteroFc-scIL10" format comprises a first monomer comprising an antigen-binding domain covalently linked to the N-terminus of a first heterodimeric Fc chain which is covalently linked via the C-terminus to a scIL-10 (optionally via a domain linker), and a second monomer comprising a complementary second heterodimeric Fc chain that is "Fc-only" or "empty-Fc". In some embodiments, the "(anti-X)$_2$-heteroFc-scIL10" format (see, e.g., FIG. 88C) comprises a first monomer comprising an antigen-binding domain covalently linked to the N-terminus of a first heterodimeric Fc chain and a second monomer comprising an antigen-binding domain covalently linked to the N-terminus of a second heterodimeric Fc chain which is covalently linked via the C-terminus to a scIL-10 (optionally via a domain linker). In some embodiments, the "(anti-X)$_2$-central-scIL10" format (see, e.g., FIG. 88D) comprises a first monomer comprising an antigen-binding domain covalently linked to the N-terminus of a first heterodimeric Fc chain and a second monomer comprising an antigen-binding domain covalently linked to a scIL-10 which is covalently linked to the N-terminus of a second heterodimeric Fc chain (optionally via a linker). In some embodiments, the "scIL10-(anti-X)$_2$-heteroFc" format (see, e.g., FIG. 88E) comprises a first monomer comprising an antigen-binding domain covalently linked to the N-terminus of a first heterodimeric Fc chain and a second monomer comprising a scIL-10 covalently linked, optionally via a linker, to an antigen-binding domain which is covalently linked to the N-terminus of a second heterodimeric Fc chain (optionally via a linker). It should be noted that while the antigen-binding domains are depicted as Fabs, the antigen-binding domain can be any antigen binding molecule as defined herein, such as an scFv. As will be appreciated, the antigen binding domain for any of the formats described herein, including those illustrated in FIG. 88A-FIG. 88E, may be directed to any suitable antigen, including without limitation CD8, NKG2D, PD-1, and TIGIT.

In some embodiments, the targeted IL-10 Fc fusion protein (e.g., targeted anti-CD8 ABD×scIL10 heterodimeric Fc fusion protein) comprises a first monomer comprising an anti-CD8 antigen-binding domain covalently linked to the N-terminus of a first heterodimeric Fc chain and a second monomer comprising a scIL-10 covalently attached to the N-terminus of a second heterodimeric Fc chain. In some embodiments, the scIL-10 is covaletly attached to the second Fc chain via a domain linker. In some embodiments, the anti-CD8 ABD comprises the VH and VL combination of 1C11B3_H1_L1. In some embodiments, the scIL-10 of the fusion protein comprises the sequence of FIG. 15C or any of the scIL10 monomer variants described herein. In some embodiments, each monomer of the scIL10 comprises an amino acid sequence as set forth in FIGS. 39A-39G, 55, 56A-56C, 57, 58, 64, and 65A-65B. In some embodiments, the scIL is selected from the group consisting of huIL10_huIL10, huIL10.22_huIL10.22, huIL10.38_huIL10.38, huIL10.64_huIL10.64, huIL10.102_huIL10.102, huIL10.104_huIL10.104, huIL10.105_huIL10.105, and huIL10.107_huIL10.107 as depicted in the figures. In some embodiments, the scIL monomer is selected from the group consisting of huIL10, huIL10.22, huIL10.38, huIL10.64, huIL10.102, huIL10.104, huIL10.105, and huIL10.107 as depicted in the figures.

In some embodiments, the targeted anti-CD8 ABD×scIL10 heterodimeric Fc fusion protein comprises a first monomer comprising a scIL10, a domain linker, and a first Fc domain; a second monomer comprising an anti-CD8 VH domain and a second Fc domain; and an anti-CD8 VL domain such that the VH domain and VL domain form an anti-CD8 ABD. In some instances, the scIL10 comprises two IL-10 monomers. In some instances, the scIL10 comprises two IL-10 monomers covalently attached by a linker.

In some embodiments, the targeted IL-10 Fc fusion protein is XENP25415, XENP25791, XENP25794, XENP26883, and XENP26879 as depicted in FIG. 96A-FIG. 96C and FIG. 98 and in the sequences corresponding to the SEQ ID NOS in the sequence listing.

In some embodiments, the targeted IL-10 Fc fusion protein (e.g., targeted anti-NKG2D ABD×scIL10 heterodimeric Fc fusion protein) comprises a first monomer comprising an anti-NKG2D antigen-binding domain covalently linked to the N-terminus of a first heterodimeric Fc chain and a second monomer comprising a scIL-10 covalently attached to the N-terminus of a second heterodimeric Fc chain. In some embodiments, the scIL-10 is covalently attached to the second Fc chain via a domain linker. In some embodiments, the anti-NKG2D ABD comprises the VH and VL combination of any selected from the group consisting of MS[NKG2D]_H0_L0, 1D7B4[NKG2D]_H1_L1, KYK-1.0 [NKG2D]_H1_L1, KYK-2.0[NKG2D]_H0_L0, 11B2D10[NKG2D]_H0_L0, 6E5A7[NKG2D]_H0_L0, 6H7E7[NKG2D]_H0_L0, mAb E[NKG2D]_H1_L1, 16F31[NKG2D]_H1_L1, mAb D[NKG2D]_H1_L1, 1 D7B4[NKG2D]_H1_L1, mAb A[NKG2D]_H1_L1, mAb A[NKG2D]_H2_L1, mAb A[NKG2D]_H1_L2, mAb A[NKG2D]_H2_L2, mAb B[NKG2D]_H1_L1, mAb B[NKG2D]_H1_L1.1, mAb B[NKG2D]_H1_L2, mAb B[NKG2D]_H2_L1, mAb B[NKG2D]_H2_L1.1, mAb B[NKG2D]_H2_L2, mAb B[NKG2D]_H3_L1, mAb B[NKG2D]_H3_L1.1, mAb B[NKG2D]_H3_L2, mAb C[NKG2D]_H1_L1, mAb C[NKG2D]_H2_L1, mAb C[NKG2D]_H1_L2, and mAb C[NKG2D]_H2_L2. In some embodiments, the scIL-10 of the fusion protein comprises the sequence of FIG. 15C or any of the scIL10 monomer variants described herein. In some embodiments, each monomer of the scIL10 comprises an amino acid sequence as set forth in FIGS. 39A-39G, 55, 56A-56C, 57, 58, 64, and 65A-65B. In some embodiments, the scIL is selected from the group consisting of huIL10_huIL10, huIL10.22_huIL10.22, huIL10.38_huIL10.38, huIL10.64_huIL10.64, huIL10.102_huIL10.102, huIL10.104_huIL10.104, huIL10.105_huIL10.105, and huIL10.107_huIL10.107 as depicted in the figures. In some embodiments, the scIL monomer is selected from the group consisting of huIL10, huIL10.22, huIL10.38, huIL10.64, huIL10.102, huIL10.104, huIL10.105, and huIL10.107 as depicted in the figures.

In some embodiments, the targeted anti-NKG2D ABD×scIL10 heterodimeric Fc fusion protein comprises a first monomer comprising a scIL10, a domain linker, and a first Fc domain; a second monomer comprising an anti-NKG2D VH domain and a second Fc domain; and an anti-NKG2D VL domain such that the VH domain and VL domain form an anti-NKG2D ABD. In some instances, the scIL10 comprises two IL-10 monomers. In some instances, the scIL10 comprises two IL-10 monomers covalently attached by a linker. In some embodiments, the NKG2D targeted IL-10 Fc fusion protein is XENP25952, XENP30526, XENP30527, XENP30528, and XENP31819 as depicted in FIG. 97A-FIG. 97C and in the sequences corresponding to the SEQ ID NOS in the sequence listing.

In some embodiments, the targeted IL-10 Fc fusion protein (e.g., targeted anti-PD-1 ABD×scIL10 heterodimeric Fc fusion protein) comprises a first monomer comprising an anti-PD-1 antigen-binding domain covalently linked to the N-terminus of a first heterodimeric Fc chain and a second monomer comprising a scIL-10 covalently attached to the N-terminus of a second heterodimeric Fc chain. In certain embodiments, the targeted IL-10 Fc fusion protein of the "anti-PD-1× heteroFc-scIL10" format comprises a first monomer comprising an anti-PD-1 antigen-binding domain covalently linked to the N-terminus of a first heterodimeric Fc chain and a second monomer comprising a scIL-10 covalently attached to the C-terminus of a second heterodimeric Fc chain. In some embodiments, the scIL-10 is covaletly attached to the second Fc chain via a domain linker. In some embodiments, the anti-PD-1 ABD comprises the VH and VL combination of any selected from the group consisting of 1C11[PD-1]_H0L0, 1C11[P, D-1]_H3L3, 1C11[PD-1]_H3.240_L3.148, 1C11[PD-1]_H3.241_L3.148, 1C11[PD-1]_H3.234_L3.144, 1C11[PD-1]_H3.241_L3.92, 1C11[PD-1]_H3.303_L3.152, 1C11_H3.329_L3.220, 1C11_H3.328_L3.152, pembrolizumab variable heavy chain and variable light chain, nivolumab variable heavy chain and variable light chain, pidilizumab variable heavy chain and variable light chain, MK-3475 variable heavy chain and variable light chain, BAP049 Clone E variable heavy chain and variable light chain, BAP049 Clone B variable heavy chain and variable light chain, H7798N[PD-1] variable heavy chain and variable light chain, h1H3 Var 6[PD-1] variable heavy chain and variable light chain, APE2058[PD-1] variable heavy chain and variable light chain, H005-1[PD-1] variable heavy chain and variable light chain, 317-4B6[PD-1] variable heavy chain and variable light chain, 326-4A3[PD-1] variable heavy chain and variable light chain, hPD-1 mAb 7 (1.2) [PD-1] variable heavy chain and variable light chain, Clone 38[PD-1] variable heavy chain and variable light chain, Clone 39[PD-1] variable heavy chain and variable light chain, Clone 41[PD-1] variable heavy chain and variable light chain, Clone 48[PD-1] variable heavy chain and variable light chain, PD1-17[PD-1] variable heavy chain and variable light chain, PD1-28[PD-1] variable heavy chain and variable light chain, PD1-33[PD-1] variable heavy chain and variable light chain, PD1-35[PD-1] variable heavy chain and variable light chain, LOPD180 variable heavy chain and variable light chain, Ab948 variable heavy chain and variable light chain, humanized EH-12.2H7[PD-1] variable heavy chain and variable light chain, RG1H10 variable heavy chain and variable light chain, RG1H10-H2A-22-1S variable heavy chain and variable light chain, RG1H10-H2A-27-2S variable heavy chain and variable light chain, RG1H10-3C variable heavy chain and variable light chain, RG1H10-16C variable heavy chain and variable light chain, RG1H10-17C variable heavy chain and variable light chain, RG1H10-19C variable heavy chain and variable light chain, RG1H10-21C variable heavy chain and variable light chain, RG1H10-23C2 variable heavy chain and variable light chain, mAb7[PD-1], and PD1AB-6[PD-1] variable heavy chain and variable light chain. In some embodiments, the scIL-10 of the fusion protein comprises the sequence of FIG. 15C or any of the scIL10 monomer variants described herein. In some embodiments, each monomer of the scIL10 comprises an amino acid sequence as set forth in FIGS. 39A-39G, 55, 56A-56C, 57, 58, 64, and 65A-65B. In some embodiments, the scIL is selected from the group consisting of huIL10_huIL10, huIL10.22_huIL10.22, huIL10.38_huIL10.38, huIL10.64_huIL10.64, huIL10.102_huIL10.102, huIL10.104_huIL10.104, huIL10.105_huIL10.105, and huIL10.107_huIL10.107 as depicted in the figures. In some embodiments, the scIL monomer is selected from the group consisting of huIL10, huIL10.22, huIL10.38, huIL10.64, huIL10.102, huIL10.104, huIL10.105, and huIL10.107 as depicted in the figures.

In some embodiments, the targeted anti-PD-1 ABD×scIL10 heterodimeric Fc fusion protein comprises a first monomer comprising from N- to C-terminal: a scIL10, a domain linker, and a first Fc domain; a second monomer comprising from N- to C-terminal: an anti-PD-1 VH domain and a second Fc domain; and an anti-PD-1 VL domain such that the VH domain and VL domain form an anti-PD-1 ABD. In certain embodiments, the targeted anti-PD-1 ABD×scIL10 heterodimeric Fc fusion protein comprises a first monomer comprising from N- to C-terminal: a first Fc domain, a domain linker, and a scIL10; a second monomer comprising from N- to C-terminal: an anti-PD-1 VH domain and a second Fc domain; and an anti-PD-1 VL domain such that the VH domain and VL domain form an anti-PD-1 ABD. In some instances, the scIL10 comprises two IL-10 monomers. In some instances, the scIL10 comprises two IL-10 monomers covalently attached by a linker. In some embodiments, the PD-1 targeted IL-10 Fc fusion protein is XENP25953, XENP27830, XENP27831, XENP31269, XENP31270, XENP31271, and XENP31272 as depicted in FIG. 101, FIGS. 102A-102C, and FIG. 103 and in the sequences corresponding to the SEQ ID NOS in the sequence listing.

In some embodiments, the targeted IL-10 Fc fusion protein (e.g., targeted non-competing anti-PD-1 ABD×scIL10 heterodimeric Fc fusion protein) comprises a first monomer comprising a non-competing anti-PD-1 antigen-binding domain covalently linked to the N-terminus of a first heterodimeric Fc chain and a second monomer comprising a scIL-10 covalently attached to the N-terminus of a second heterodimeric Fc chain. In certain embodiments, the targeted IL-10 Fc fusion protein of the "anti-PD-1× heteroFc-scIL10" format comprises a first monomer comprising a non-competing anti-PD-1 antigen-binding domain covalently linked to the N-terminus of a first heterodimeric Fc chain and a second monomer comprising a scIL-10 covalently attached to the C-terminus of a second heterodimeric Fc chain. In some embodiments, the scIL-10 is covalently attached to the second Fc chain via a domain linker. In some embodiments, the anti-PD-1 ABD comprises the VH and VL combination of any selected from the group consisting of mAb A[PD-1]_H1_L1, mAb B[PD-1]_H1_L1, mAb C[PD-1]_H1_L1, mAb C[PD-1]_H1_L1.1, mAb C[PD-1]_H1_L1.3, mAb C[PD-1]_H1_L1.45, mAb C[PD-1]_H1_L1.117, mAb C[PD-1]_H1_L1.129, mAb C[PD-1]_H1_L1.135, mAb C[PD-1]_H1_L1.136, mAb C[PD-1]_H1_L1.140, mAb C[PD-1]_H1_L2, mAb C[PD-1]_H1.19_11, mAb C[PD-1]_H1.19_L1.1, mAb C[PD-1]_H1.19_L1.3, mAb C[PD-1]_H1.19_L1.45, mAb C[PD-1]_H1.19_L1.117, mAb C[PD-1]_H1.19_L1.129, mAb C[PD-1]_H1.19_L1.135, mAb C[PD-1]_H1.19_L1.136, mAb C[PD-1]_H1.19_L1.140, mAb C[PD-1]_H1.19_L2, mAb C[PD-1]_H1.48_11, mAb C[PD-1]_H1.48_L1.1, mAb C[PD-1]_H1.48_L1.3, mAb C[PD-1]_H1.48_L1.45, mAb C[PD-1]_H1.48_L1.117, mAb C[PD-1]_H1.48_L1.129, mAb C[PD-1]_H1.48_L1.135, mAb C[PD-1]_H1.48_L1.136, mAb C[PD-1]_H1.48_L1.140, mAb C[PD-1]_H1.48_L2, mAb C[PD-1]_H1.125_11, mAb C[PD-1]_H1.125_L1.1, mAb C[PD-1]_H1.125_L1.3, mAb C[PD-1]_H1.125_L1.45, mAb C[PD-1]_H1.125_L1.117, mAb C[PD-1]_H1.125_L1.129, mAb C[PD-1]_H1.125_L1.135, mAb C[PD-1]_H1.125_L1.136, mAb C[PD-1]_H1.125_L1.140, mAb C[PD-1]_H1.125_L2, mAb C[PD-1]_H1.130_11, mAb C[PD-1]_H1.130_L1.1, mAb C[PD-1]_H1.130_L1.3, mAb C[PD-1]_H1.130_L1.45, mAb C[PD-1]_H1.130_L1.117, mAb C[PD-1]_H1.130_L1.129, mAb C[PD-1]_H1.130_L1.135, mAb C[PD-1]_H1.130_L1.136, mAb C[PD-1]_H1.130_L1.140, mAb C[PD-1]_H1.130_L2, mAb C[PD-1]_H1.132_11, mAb C[PD-1]_H1.132_L1.1, mAb C[PD-1]_H1.132_L1.3, mAb C[PD-1]_H1.132_L1.45, mAb C[PD-1]_H1.132_L1.117, mAb C[PD-1]_H1.132_L1.129, mAb C[PD-1]_H1.132_L1.135, mAb C[PD-1]_H1.132_L1.136, mAb C[PD-1]_H1.132_L1.140, mAb C[PD-1]_H1.132_L2, mAb C[PD-1]_H1.169_11, mAb C[PD-1]_H1.169_L1.1, mAb C[PD-1]_H1.169_L1.3, mAb C[PD-1]_H1.169_L1.45, mAb C[PD-1]_H1.169_L1.117, mAb C[PD-1]_H1.169_L1.129, mAb C[PD-1]_H1.169_L1.135, mAb C[PD-1]_H1.169_L1.136, mAb C[PD-1]_H1.169_L1.140, mAb C[PD-1]_H1.169_L2, mAb C[PD-1]_H1.175_11, mAb C[PD-1]_H1.175_L1.1, mAb C[PD-1]_H1.175_L1.3, mAb C[PD-1]_H1.175_L1.45, mAb C[PD-1]_H1.175_L1.117, mAb C[PD-1]_H1.175_L1.129, mAb C[PD-1]_H1.175_L1.135, mAb C[PD-1]_H1.175_L1.136, mAb C[PD-1]_H1.175_L1.140, mAb C[PD-1]_H1.175_L2, mAb C[PD-1]_H2_L1, mAb C[PD-1]_H2_L1.1, mAb C[PD-1]_H2_L1.3, mAb C[PD-1]_H2_L1.45, mAb C[PD-1]_H2_L1.117, mAb C[PD-1]_H2_L1.129, mAb C[PD-1]_H2_L1.135, mAb C[PD-1]_H2_L1.136, mAb C[PD-1]_H2_L1.140, and mAb C[PD-1]_H2_L2.

In some embodiments, the targeted non-competing anti-PD-1 ABD×scIL10 heterodimeric Fc fusion protein comprises a first monomer comprising from N- to C-terminal: a scIL10, a domain linker, and a first Fc domain; a second monomer comprising from N- to C-terminal: an anti-PD-1 VH domain and a second Fc domain; and an anti-PD-1 VL domain such that the VH domain and VL domain form a non-competing anti-PD-1 ABD. In certain embodiments, the targeted non-competing anti-PD-1 ABD×scIL10 heterodimeric Fc fusion protein comprises a first monomer comprising from N- to C-terminal: a first Fc domain, a domain linker, and a scIL10; a second monomer comprising from N- to C-terminal: an anti-PD-1 VH domain and a second Fc domain; and an anti-PD-1 VL domain such that the VH domain and VL domain form a non-competing anti-PD-1 ABD. In some instances, the scIL10 comprises two IL-10 monomers. In some instances, the scIL10 comprises two IL-10 monomers covalently attached by a linker. In some embodiments, the non-competing PD-1 targeted IL-10 Fc fusion protein is XENP30520, XENP30521, XENP30522, XENP31266, XENP31267, and XENP31268 as depicted in FIGS. 106A-106C and in the sequences corresponding to the SEQ ID NOs in the sequence listing. XENP30520 is also referred to as αPD-1(mAb C_H1_L1.1)×huIL10.104. XENP30521 is also referred to as αPD-1(mAb C_H1_L1.1)×huIL10.105. XENP30522 is also referred to as αPD-1(mAb C_H1_L1.1)×huIL10.107.

In some embodiments, the targeted IL-10 Fc fusion protein (e.g., targeted non-competing anti-TIGIT ABD×scIL10 heterodimeric Fc fusion protein) comprises a first monomer comprising a non-competing anti-TIGIT antigen-binding domain covalently linked to the N-terminus of a first heterodimeric Fc chain and a second monomer comprising a scIL-10 covalently attached to the N-terminus of a second heterodimeric Fc chain. In certain embodiments, the targeted IL-10 Fc fusion protein of the "anti-TIGIT×heteroFc-scIL10" format comprises a first monomer comprising an anti-TIGIT antigen-binding domain covalently linked to the N-terminus of a first heterodimeric Fc chain and a second monomer comprising a scIL-10 covalently attached to the C-terminus of a second heterodimeric Fc chain. In some embodiments, the scIL-10 is covalently attached to the second Fc chain via a domain linker. In some embodiments, the anti-TIGIT ABD comprises the VH and VL combination of any selected from the group consisting of 2A5B4[TIGIT]_H1_L1, Genentech_4.1 D3.Q1E(tiragolumab)_H0_L0, 10A7 [TIGIT] variable heavy chain and variable light chain, 1F4[TIGIT] variable heavy chain and variable light chain, 4.1D3[TIGIT] variable heavy chain and variable light chain, Hu14D7 VH1_VL1, Hu14D7 VH1_VL2, Hu14D7 VH1_VL3, Hu14D7 VH2_VL1, Hu14D7 VH2_VL2, Hu14D7 VH2_VL3, Hu14D7 VH3_VL1, Hu14D7 VH3_VL2, Hu14D7 VH3_VL3, Hu26B10 VH1_VL1, Hu26B10 VH1_VL2, Hu26B10 VH1_L3, Hu26B10 VH2_VL1, Hu26B10 VH2_VL2, Hu26B10 VH2_VL3, Hu26B10 VH3_VL1, Hu26B10 VH3_L2, Hu26B10 VH3_VL3, MEB125.31C6.A1.205 VH4/VL1, MEB125.31C6.A1.205 VH5/VL4, MEB125.31C6.A1.205 VH5/VL3, 15A6 variable heavy chain and variable light chain, 22G2 variable heavy chain and variable light chain, 11G11 variable heavy chain and variable light chain, 10D7 variable heavy chain and variable light chain, 313R19 variable heavy chain and variable light chain, and etigilimab variable heavy chain and variable light chain.

In some embodiments, the targeted anti-TIGIT ABD×scIL10 heterodimeric Fc fusion protein comprises a first monomer comprising from N- to C-terminal: a scIL10, a domain linker, and a first Fc domain; a second monomer comprising from N- to C-terminal: an anti-TIGIT VH domain and a second Fc domain; and an anti-TIGIT VL domain such that the VH domain and VL domain form an anti-TIGIT ABD. In certain embodiments, the targeted anti-TIGIT ABD×scIL10 heterodimeric Fc fusion protein comprises a first monomer comprising from N- to C-terminal: a first Fc domain, a domain linker, and a scIL10; a second monomer comprising from N- to C-terminal: an anti-TIGIT VH domain and a second Fc domain; and an anti-TIGIT VL domain such that the VH domain and VL domain form a non-competing anti-TIGIT ABD. In some instances, the scIL10 comprises two IL-10 monomers. In some instances, the scIL10 comprises two IL-10 monomers covalently attached by a linker. In some embodiments, the anti-TIGIT targeted IL-10 Fc fusion protein is XENP30523, XENP30524, and XENP30525 as depicted in FIGS. 123A-123B and in the sequences corresponding to the SEQ ID NOS in the sequence listing.

XENP30523 is also referred to as αTIGIT(2A5B4)×huIL10.104. XENP30524 is also referred to as αTIGIT(2A5B4)×huIL10.105. XENP30525 is also referred to as αTIGIT(2A5B4)×huIL10.107.

C. Targeted IL10M1-Fc Fusion Formats

FIG. 89A-FIG. 89M depict further embodiments for targeted IL-10 fusions based on the IL10M1-Fc category, herein referred to as the "targeted IL10M1-Fc" category. In some embodiments, the "anti-X×(IL10M1)$_1$-heteroFc" format (see, e.g., FIG. 89A) comprises a first monomer comprising an antigen-binding domain covalently linked to the N-terminus of a first heterodimeric Fc chain and a second monomer comprising an IL10M1 covalently attached to the N-terminus of a second heterodimeric Fc chain (optionally via a domain linker). In some embodiments, the "anti-X×heteroFc-(IL10M1)$_1$" format (see, e.g., FIG. 89B) comprises a first monomer comprising an antigen-binding domain covalently linked to the N-terminus of a first heterodimeric Fc chain and a second monomer comprising a second heterodimeric Fc chain covalently linked via the C-terminus to an IL10M1 (optionally via a domain linker). In some embodiments, the "anti-X×heteroFc-(IL10M1)$_1$" format comprises a first monomer comprising an antigen-binding domain covalently linked to the N-terminus of a first heterodimeric Fc chain which is covalently linked via the C-terminus to an IL10M1 (optionally via a domain linker), and a second monomer comprising a complementary second heterodimeric Fc chain that is "Fc-only" or "empty-Fc". In some embodiments, the "(anti-X)$_2$-heteroFc-(IL10M1)1" format (see, e.g., FIG. 89C) comprises a first monomer comprising an antigen-binding domain covalently linked to the N-terminus of a first heterodimeric Fc chain and a second monomer comprising an antigen-binding domain covalently linked to the N-terminus of a second heterodimeric Fc chain which is covalently linked via the C-terminus to an IL10M1 (optionally via a domain linker). In some embodiments, the "(IL10M1)1-(anti-X)$_2$-heteroFc" format (see, e.g., FIG. 89D) comprises a first monomer comprising an antigen-binding domain covalently linked to the N-terminus of a first heterodimeric Fc chain and a second monomer comprising an IL10M1 covalently linked, optionally via a linker, to an antigen-binding domain which is covalently linked to the N-terminus of a second heterodimeric Fc chain (optionally via a linker). In some embodiments, the "(anti-X)$_2$-central-(IL10M1)1" format (see, e.g., FIG. 89E) comprises a first monomer comprising an antigen-binding domain covalently linked to the N-terminus of a first heterodimeric Fc chain and a second monomer comprising an antigen-binding domain covalently linked to an IL10M1 which is covalently linked to the N-terminus of a second heterodimeric Fc chain (optionally via a linker). In some embodiments, the "anti-X×(IL10M1)$_2$-heteroFc" format (see, e.g., FIG. 89F) comprises a first monomer comprising an antigen-binding domain covalently linked to the N-terminus of a first heterodimeric Fc chain and a second monomer comprising a first IL10M1 covalently attached, optionally via a domain linker, to a second IL10M1 which is covalently attached to the N-terminus of a second heterodimeric Fc chain (optionally via a domain linker). In some embodiments, the "anti-X×heteroFc-(IL10M1)$_2$" format (see, e.g., FIG. 89G) comprises a first monomer comprising an antigen-binding domain covalently linked to the N-terminus of a first heterodimeric Fc chain and a second monomer comprising a second heterodimeric Fc chain covalently linked via the C-terminus to a first IL10M1 (optionally via a domain linker) which is covalently attached, optionally via a domain linker, to a second IL10M1. In some embodiments, the "anti-X×heteroFc-(IL10M1)$_2$" format comprises a first monomer comprising an antigen-binding domain covalently linked to the N-terminus of a first heterodimeric Fc chain which is covalently linked via the C-terminus to a first IL10M1 (optionally via a domain linker) which is covalently linked, optionally via a domain linker, to a second IL10M1, and a second monomer comprising a complementary second heterodimeric Fc chain that is "Fc-only" or "empty-Fc". In some embodiments, the "(anti-X)$_2$-heteroFc-(IL10M1)$_2$" format (see, e.g., FIG. 89H) comprises a first monomer comprising an antigen-binding domain covalently linked to the N-terminus of a first heterodimeric Fc chain and a second monomer comprising an antigen-binding domain covalently linked to the N-terminus of a second heterodimeric Fc chain which is covalently linked via the C-terminus to a first IL10M1 (optionally via a domain linker) which is covalently attached, optionally via a domain linker, to a second IL10M1. In some embodiments, the "(IL10M1)$_2$-(anti-X)$_2$-heteroFc" format (see, e.g., FIG. 89I) comprises a first monomer comprising an antigen-binding domain covalently linked to the N-terminus of a first heterodimeric Fc chain and a second monomer comprising a first IL10M1 covalently linked, optionally via a linker, to a second IL10M1 which is covalently attached (optionally via a domain linker) to an antigen-binding domain which is covalently linked to the N-terminus of a second heterodimeric Fc chain (optionally via a linker). In some embodiments, the "(anti-X)₂-central-(IL10M1)₂" format (see, e.g., FIG. 89J) comprises a first monomer comprising an antigen-binding domain covalently linked to the N-terminus of a first heterodimeric Fc chain and a second monomer comprising an antigen-binding domain covalently linked to a first IL10M1 which is covalently linked, optionally via a domain linker, to a second IL10M1 which is covalently attached to the N-terminus of a second heterodimeric Fc chain (optionally via a linker). In some embodiments, the "mAb-(IL10M1)₂" format (see, e.g., FIG. 89K) comprises two identical monomers, each monomer comprising an antigen-binding domain covalently linked to the N-terminus of a homodimeric Fc chain which is covalently linked via the C-terminus, optionally via a linker, to an IL10M1. In some embodiments, the "(IL10M1)₂-mAb" format (see, e.g., FIG. 89L) comprises two identical monomers, each monomer comprising an IL10M1 covalently linked, optionally via a linker, to an antigen-binding domain which is covalently linked to the N-terminus of a homodimeric Fc chain. In some embodiments, the "mAb-central-(IL10M1)₂" format (see, e.g., FIG. 89M) comprises two identical monomers, each monomer comprising an antigen-binding domain covalently linked to an IL10M1 which is covalently linked, optionally via a linker, to a homodimeric Fc chain. It should be noted that while the antigen-binding domains are depicted as Fabs, the antigen-binding domain can be any antigen binding molecule as defined herein, such as an scFv.

In some embodiments, the targeted IL-10 Fc fusion protein (e.g., targeted anti-CD8×IL10M1 heterodimeric Fc fusion protein) comprises an anti-CD8 ABD covalently linked to the N-terminus of a first heterodimeric Fc chain and a second monomer comprising an IL10M1 covalently attached to the N-terminus of a second heterodimeric Fc chain. In some embodiments, the IL10M1 is covalently attached to the N-terminus of a second heterodimeric Fc chain via a domain linker. In some embodiments, the anti-CD8 ABD comprises the VH and VL combination of OKT8_H2_L1. In some embodiments, the anti-CD8 ABD comprises the VH and VL combination of 1C11B3_H1_L1. In some embodiments, the targeted IL-10 Fc fusion protein is XENP25365 or XENP25366 as depicted in FIG. 94 and in the sequences corresponding to the SEQ ID NOs in the sequence listing.

In some embodiments, the targeted IL-10 Fc fusion protein (e.g., targeted anti-CD8 mAb×(IL10M1)₂ heterodimeric Fc fusion protein) comprises two identical monomers, each monomer comprising an anti-CD8 ABD covalently linked to the N-terminus of a homodimeric Fc chain which is covalently linked via the C-terminus to an IL10M1. In some embodiments, the Fc chain is connected to the IL10M1 via a linker. In some embodiments, each monomer comprises two chains such that the first chain comprises from N- to C-terminus: a VH domain of an anti-CD8 ABD, an Fc domain, an optional linker, and an IL10M1, and the second chain comprises a VL domain of an anti-CD9 ABD. In some embodiments, the anti-CD8 ABD comprises the VH and VL combination of 1C11B3_H1_L1. In some embodiments, the targeted IL-10 Fc fusion protein is XENP26172 as depicted in FIG. 95 and in the sequences corresponding to the SEQ ID NOs in the sequence listing.

D. Targeted SplitIL10-Fc Fusion Formats

FIG. 90A-FIG. 90H depict further embodiments for targeted IL-10 fusions based on the splitIL10-Fc category, herein referred to as the "targeted splitIL10-Fc" category. In some embodiment, the "anti-X×(splitIL10)₁-heteroFc" format (see, e.g., FIG. 90A) comprises a first monomer comprising an antigen-binding domain covalently linked to the N-terminus of a first heterodimeric Fc chain and a second monomer comprising a hIL-10(A-D) domain covalently attached to the N-terminus of a second heterodimeric Fc chain (optionally via a domain linker), and a hIL-10(E-F) domain transfected separately so that it non-covalently interacts with the hIL-10(A-D) domain. In some embodiment, the "anti-X×(splitIL10)₁-heteroFc" format comprises a first monomer comprising an antigen-binding domain covalently linked to the N-terminus of a first heterodimeric Fc chain and a second monomer comprising a hIL-10(E-F) domain covalently attached to the N-terminus of a second heterodimeric Fc chain (optionally via a domain linker), and a hIL-10(A-D) domain transfected separately so that it non-covalently interacts with the hIL-10(E-F) domain. In some embodiment, the "(anti-X)₂× heteroFc-(splitIL10)₁" format (see, e.g., FIG. 90B) comprises a first monomer comprising an antigen-binding domain covalently attached to the N-terminus of a first heterodimeric Fc chain which is covalently linked via the C-terminus to a hIL-10(A-D) domain and a second monomer comprising an antigen-binding domain covalently linked to the N-terminus of a second heterodimeric Fc chain covalently linked via the C-terminus to a hIL-10(E-F) domain. In some embodiment, the "(splitIL10)₁-(anti-X)₂-heteroFc" format (see, e.g., FIG. 90C) comprises a first monomer comprising an hIL-10(A-D) domain covalently attached to an antigen-binding domain which is covalently attached to the N-terminus of a first heterodimeric Fc chain and a second monomer comprising an hIL-10(E-F) domain covalently attached to an antigen-binding domain which is covalently attached to the N-terminus of a second heterodimeric Fc chain. In some embodiment, the "(anti-X)₂-central-(splitIL10)₁-heteroFc" format (see, e.g., FIG. 90D) comprises a first monomer comprising an antigen-binding domain covalently attached to a hIL-10(A-D) domain which is covalently attached to a first heterodimeric Fc chain and a second monomer comprising an antigen-binding domain covalently attached to a hIL-10(E-F) domain which is covalently attached to a second heterodimeric Fc chain. In some embodiment, the "anti-X×(splitIL10)2-heteroFc" format (see, e.g., FIG. 90E) comprises a first monomer comprising an antigen-binding domain covalently linked to the N-terminus of a first heterodimeric Fc chain and a second monomer comprising a first hIL-10(A-D) domain covalently attached to a second hIL-10(A-D) domain which is covalently attached to the N-terminus of a second heterodimeric Fc chain (optionally via a domain linker), and a first hIL-10(E-F) domain covalently attached to a second hIL-10(E-F) domain transfected separately so that they non-covalently interacts with the hIL-10(A-D) domains. In some embodiment, the "anti-X×(splitIL10)2-heteroFc" format comprises a first monomer comprising an antigen-binding domain covalently linked to the N-terminus of a first heterodimeric Fc chain and a second monomer comprising a first hIL-10(E-F) domain covalently attached to a second hIL-10(E-F) domain which is covalently attached to the N-terminus of a second heterodimeric Fc chain (optionally via a domain linker), and a first hIL-10(A-D) domain covalently attached to a second hIL-10(A-D) domain transfected separately so that they non-covalently interact with the hIL-10(E-F) domains. In some embodiment, the "(anti-X)₂× heteroFc-(splitIL10)₂" format (see, e.g., FIG. 90F) comprises a first monomer comprising an antigen-binding domain covalently attached to the N-terminus of a first heterodimeric Fc chain which is covalently linked via the C-terminus to a first hIL-10(A-D) domain covalently attached to a second hIL- 10(A-D) domain and a second monomer comprising an antigen-binding domain covalently linked to the N-terminus of a second heterodimeric Fc chain covalently linked via the C-terminus to a first hIL-10(E-F) domain covalently attached to a second hIL-10(E-F) domain. In some embodiment, the "(splitIL10)2-(anti-X)$_2$-heteroFc" format (see, e.g., FIG. 90G) comprises a first monomer comprising a first hIL-10(A-D) domain covalently attached to a second hIL-10(A-D) domain which is covalently attached to an antigen-binding domain which is covalently attached to the N-terminus of a first heterodimeric Fc chain and a second monomer comprising a first hIL-10(E-F) domain covalently attached to a second hIL-10(E-F) domain which is covalently attached to an antigen-binding domain which is covalently attached to the N-terminus of a second heterodimeric Fc chain. In some embodiment, the "(anti-X)$_2$-central-(splitIL10)2-heteroFc" format (see, e.g., FIG. 90H) comprises a first monomer comprising an antigen-binding domain covalently attached to a first hIL-10(A-D) domain which is covalently attached to a second hIL-10(A-D) domain which is covalently attached to a first heterodimeric Fc chain and a second monomer comprising an antigen-binding domain covalently attached to a first hIL-10(E-F) domain which is covalently attached to a second hIL-10(E-F) domain which is covalently attached to a second heterodimeric Fc chain.

E. Additional Targeted IL10 Containing Fc Fusion Formats

In some embodiments of the (anti-X)$_2$-central-scIL10 format, the heterodimeric Fc fusion protein comprises: a) a first fusion protein comprising a first antigen binding domain and a first Fc domain, wherein the first antigen binding domain is covalently attached to the N-terminus of the first Fc domain; and b) a second fusion protein comprising a second antigen binding domain, a second Fc domain, a first protein domain and a second protein domain, wherein the first protein domain is covalently attached to the second protein domain, wherein the second protein domain is covalently attached to the N-terminus of the second Fc domain, and wherein the first protein domain is covalent attached to the second antigen binding domain; wherein the first and the second Fc domains comprise modifications promoting heterodimerization of the first and the second Fc domains, and wherein the first protein domain comprises a first IL-10 monomer and the second protein domain comprises a second IL-10 monomer.

In some embodiments of the scIL10-(anti-X)$_2$-heteroFc format, the heterodimeric Fc fusion protein comprises: a) a first fusion protein comprising a first antigen binding domain and a first Fc domain, wherein the first antigen binding domain is covalently attached to the N-terminus of the first Fc domain; and b) a second fusion protein comprising a second antigen binding domain, a second Fc domain, a first protein domain and a second protein domain, wherein the second antigen binding domain is covalently attached to the N-terminus of the second Fc domain, wherein the first protein domain is covalently attached to the second protein domain, and wherein the second protein domain is covalently attached to the second antigen binding domain; wherein the first and the second Fc domains comprise modifications promoting heterodimerization of the first and the second Fc domains, and wherein the first protein domain comprises a first IL-10 monomer and the second protein domain comprises a second IL-10 monomer.

In some embodiments of the scIL10-(anti-X)$_2$-heteroFc anti-Xx(IL10M1)$_1$-heteroFc format, the heterodimeric Fc fusion protein comprises: a) a first fusion protein comprises a first antigen binding domain and a first Fc domain, wherein the first antigen binding domain is covalently attached to the N-terminus of the first Fc domain; and b) a second fusion protein comprising a protein domain and a second Fc domain, wherein the protein domain is covalently attached to the second Fc domain; wherein the first and the second Fc domains comprise modifications promoting heterodimerization of the first and the second Fc domains and wherein the protein domain comprises an IL-10 monomer domain that comprises an insert peptide. In some embodiments, the protein domain is covalently attached to the N-terminus of the second Fc domain. In some embodiments, the protein domain is covalently attached to the C-terminus of the second Fc domain.

In some embodiments of the (anti-X)2× heteroFc-(IL10M1)1 format, the heterodimeric Fc fusion protein comprises: a) a first fusion protein comprising a first antigen binding domain, a first protein domain, and a first Fc domain, wherein the first antigen binding domain is covalently attached to the N-terminus of the first Fc domain; and b) a second fusion protein comprising a second antigen binding domain and a second Fc domain, wherein the second antigen binding domain is covalently attached to the N-terminus of the second Fc domain; wherein the first and the second Fc domains comprise modifications promoting heterodimerization of the first and the second Fc domains, and wherein the protein domain comprises an IL-10 monomer domain that comprises an insert peptide.

In some embodiments, the first protein domain is covalently attached to the C-terminus of the first Fc domain. In some embodiments, the first protein domain is covalently attached to the N-terminus of the first antigen binding domain.

In some embodiments of the (anti-X)$_2$-central-(IL10M1)1-heteroFc format, the heterodimeric Fc fusion protein comprises: a) a first fusion protein comprising a first antigen binding domain, a first protein domain, and a first Fc domain, wherein the first antigen binding domain is covalently attached to the first protein domain and wherein the first protein domain is covalently attached to the N-terminus of the first Fc domain; and b) a second fusion protein comprising a second antigen binding domain and a second Fc domain, wherein the second antigen binding domain is covalently attached to the N-terminus of the second Fc domain; wherein the first and the second Fc domains comprise modifications promoting heterodimerization of the first and the second Fc domains, and wherein the protein domain comprises an IL-10 monomer domain that comprises an insert peptide.

In some embodiments of the anti-Xx(IL10M1)2-heteroFc format, the heterodimeric Fc fusion protein comprises: a) a first fusion protein comprising a first antigen binding domain and a first Fc domain, wherein the first antigen binding domain is covalently attached to the N-terminus of the first Fc domain; and b) a second fusion protein comprising a first protein domain, a second protein domain, and a second Fc domain, wherein the first protein domain is covalently attached to the second protein domain, and wherein the second protein domain is covalently attached to the N-terminus of the second Fc domain; wherein the first and the second Fc domains comprise modifications promoting heterodimerization of the first and the second Fc domains, and wherein the first and second protein domain each comprises an IL-10 monomer that comprises an insert peptide.

In some embodiments of the anti-XxheteroFc-(IL10M1)2 format, the heterodimeric Fc fusion protein comprises: a) a first fusion protein comprising a first antigen binding domain and a first Fc domain, wherein the first antigen binding domain is covalently attached to the N-terminus of the first Fc domain; b) a second Fc domain; and c) a first protein domain and a second protein domain, wherein the first protein domain is covalently attached to the second protein domain, wherein the first and the second Fc domains comprise modifications promoting heterodimerization of the first and the second Fc domains, and wherein the first and second protein domain each comprises an IL-10 monomer that comprises an insert peptide. In some embodiments, the first protein domain is covalently attached to the second protein domain, and wherein the second protein domain is covalently attached to the C-terminus of the first Fc domain. In some embodiments, the first protein domain is covalently attached to the second protein domain, and wherein the second protein domain is covalently attached to the C-terminus of the second Fc domain.

In some embodiments of the anti-X×heteroFc-(IL10M1)2 format, the heterodimeric Fc fusion protein comprises: a) a first fusion protein comprising a first antigen binding domain, a first protein domain, a second protein domain, and a first Fc domain, wherein the first antigen binding domain is covalently attached to the N-terminus of the first Fc domain, and wherein the first protein domain is covalently attached to the second protein domain and the second protein domain is covalently attached to the C-terminus of the first Fc domain; and b) a second fusion protein comprising a second antigen binding domain and a second Fc domain, wherein the second antigen binding domain is covalently attached to the second Fc domain; wherein the first and the second Fc domains comprise modifications promoting heterodimerization of the first and the second Fc domains, and wherein the first and second protein domain each comprises an IL-10 monomer domain that comprises an insert peptide.

In some embodiments of the anti-X×heteroFc-(IL10M1)2 format, the heterodimeric Fc fusion protein comprises:) a first fusion protein comprising a first antigen binding domain, a first protein domain, a second protein domain, and a first Fc domain, wherein the first antigen binding domain is covalently attached to the N-terminus of the first Fc domain, and wherein the first protein domain is covalently attached to the second protein domain and the second protein domain is covalently attached to the N-terminus of the first antigen binding domain; and b) a second fusion protein comprising a second antigen binding domain and a second Fc domain, wherein the second antigen binding domain is covalently attached to the second Fc domain; wherein the first and the second Fc domains comprise modifications promoting heterodimerization of the first and the second Fc domains, and wherein the first and second protein domain each comprises an IL-10 monomer domain that comprises an insert peptide.

In some embodiments of the anti-X)$_2$-central-(IL10M1)$_2$-heteroFc format, the heterodimeric Fc fusion protein comprises: a) a first fusion protein comprising a first antigen binding domain, a first protein domain, a second protein domain, and a first Fc domain, wherein the first protein domain is covalently attached to the second protein domain and the second protein domain is covalently attached to the N-terminus of the first Fc domain, and wherein the first antigen binding domain is covalently attached to the N-terminus of the first protein domain; and b) a second fusion protein comprising a second antigen binding domain and a second Fc domain, wherein the second antigen binding domain is covalently attached to the second Fc domain; wherein the first and the second Fc domains comprise modifications promoting heterodimerization of the first and the second Fc domains, and wherein the first and second protein domain each comprises an IL-10 monomer domain that comprises an insert peptide.

In some embodiments of the mAb-(IL10M1)2 format, the heterodimeric Fc fusion protein comprises: a) a first fusion protein comprising a first antigen binding domain, a first protein domain, and a first Fc domain, wherein the first antigen binding domain is covalently attached to the N-terminus of the Fc domain; and b) a second fusion protein comprising a second antigen binding domain, a second Fc domain, and a second protein domain, wherein the second antigen binding domain is covalently attached to the N-terminus of the second Fc domain; wherein the first and the second Fc domains comprise modifications promoting heterodimerization of the first and the second Fc domains, and wherein the first and second protein domain each comprises an IL-10 monomer that comprises an insert peptide. In some embodiments, the first protein domain is covalently attached to the C-terminus of the first Fc domain and the second protein domain is covalently attached to the C-terminus of the second Fc domain. In some embodiments, the first protein domain is covalently attached to the N-terminus of the first antigen binding domain and the second protein domain is covalently attached to the N-terminus of the second antigen binding domain.

In some embodiments of the mAb-central-(IL10M1)2 format, the heterodimeric Fc fusion protein comprises: a) a first fusion protein comprising a first antigen binding domain, a first protein domain, and a first Fc domain, wherein the first antigen binding domain is covalently attached to the N-terminus of the first protein domain, and wherein the first protein domain is covalently attached to the N-terminus of the first Fc domain; and b) a second fusion protein comprising a second antigen binding domain, a second Fc domain, and a second protein domain, wherein the second antigen binding domain is covalently attached to the N-terminus of the second protein domain, and wherein the second protein domain is covalently attached to the N-terminus of the second Fc domain; wherein the first and the second Fc domains comprise modifications promoting heterodimerization of the first and the second Fc domains, and wherein the first and second protein domain each comprises an IL-10 monomer that comprises an insert peptide.

In some embodiments of the mAb-central-(IL10M1)2 format, the heterodimeric Fc fusion protein comprises: a) a first fusion protein comprising a first antigen binding domain, a first protein domain, and a first Fc domain, wherein the first antigen binding domain is covalently attached to the N-terminus of the first protein domain, and wherein the first protein domain is covalently attached to the N-terminus of the first Fc domain; and b) a second fusion protein comprising a second antigen binding domain, a second Fc domain, and a second protein domain, wherein the second antigen binding domain is covalently attached to the N-terminus of the second protein domain, and wherein the second protein domain is covalently attached to the N-terminus of the second Fc domain; wherein the first and the second Fc domains comprise modifications promoting heterodimerization of the first and the second Fc domains, and wherein the first and second protein domain each comprises an IL-10 monomer that comprises an insert peptide.

In some embodiments of the anti-X×(splitIL10)1-heteroFc format, the heterodimeric Fc fusion protein comprises: a) a first fusion protein comprising a first antigen binding domain and a first Fc domain, wherein the first antigen binding domain is covalently attached to the N-terminus of the first Fc domain; and b) a second fusion protein comprising a second Fc domain and a first protein domain, wherein the second Fc domain is covalently attached to the first protein domain; wherein the first and the second Fc domains comprise modifications promoting heterodimerization of the first and the second Fc domains, and wherein the first protein domain comprises helices (A-D) of human IL-10. In some embodiments, the heterodimeric Fc fusion protein further comprises a second protein domain non-covalently attached to the first protein domain. In some embodiments, the second protein domain comprises helices (E-F) of human IL-10.

In some embodiments of the (anti-X)$_2$× heteroFc-(splitIL10)1 format, the heterodimeric Fc fusion protein comprises: a) a first fusion protein comprising a first protein domain, a first antigen binding domain and a first Fc domain, wherein the first antigen binding domain is covalently attached to the N-terminus of the first Fc domain; and b) a second fusion protein comprising a second protein domain, a second antigen binding domain, and a second Fc domain, wherein the second antigen binding domain is covalently attached to the N-terminus of the second Fc domain, wherein the first and the second Fc domains comprise modifications promoting heterodimerization of the first and the second Fc domains, and wherein the first protein domain is a human IL-10(A-D) domain and the second protein domain is a human IL-10(E-F) domain. In some embodiments, the first protein domain is covalently attached to the C-terminus of the first Fc domain and the second protein domain is covalently attached to the C-terminus of the second Fc domain. In some embodiments, the first protein domain is covalently attached to the N-terminus of the first antigen binding domain and the second protein domain is covalently attached to the N-terminus of the second antigen binding domain.

In some embodiments of the (anti-X)$_2$-central-(splitIL10)$_1$-hetero Fc format, the heterodimeric Fc fusion protein comprises: a) a first fusion protein comprising a first protein domain, a first antigen binding domain and a first Fc domain, wherein the first antigen binding domain is covalently attached to the first protein domain, and the first protein domain is covalently attached to the N-terminus of the first Fc domain; and b) a second fusion protein comprising a second protein domain, a second antigen binding domain, and a second Fc domain, wherein the second antigen binding domain is covalently attached to the second protein domain, and the second protein domain is covalently attached to the N-terminus of the second Fc domain, wherein the first and the second Fc domains comprise modifications promoting heterodimerization of the first and the second Fc domains, and wherein the first protein domain is a human IL-10(A-D) domain and the second protein domain is a human IL-10(E-F) domain.

In some embodiments of the anti-X×(splitIL10)$_2$-heteroFc format, the heterodimeric Fc fusion protein comprises: a) a first fusion protein comprising a first antigen binding domain and a first Fc domain, wherein the first antigen binding domain is covalently attached to the N-terminus of the first Fc domain; and b) a second fusion protein comprising a first protein domain, and a second protein domain, and a second Fc domain, wherein the first and the second Fc domains comprise modifications promoting heterodimerization of the first and the second Fc domains, and wherein the first protein domain comprises a first human IL-10(A-D) sequence covalently attached to a second human IL-10(A-D) sequence and the second protein domain comprises a first human IL-10(E-F) sequence covalently attached to a second human IL-10(E-F) sequence. In some embodiments, the first protein domain is covalently attached to the second Fc domain and the second protein domain is non-covalently attached to the first protein domain. In some embodiments, the second protein domain is covalently attached to the second Fc domain and the first protein domain is non-covalently attached to the second protein domain.

In some embodiments of the anti-X)$_2$× heteroFc-(splitIL10)2 format, the heterodimeric Fc fusion protein comprises: a) a first fusion protein comprising a first protein domain, a first antigen binding domain and a first Fc domain; and b) a second fusion protein comprising a second protein domain, a second antigen binding domain, and a second Fc domain, wherein the first and the second Fc domains comprise modifications promoting heterodimerization of the first and the second Fc domains, and wherein the first protein domain comprises a first human IL-10(A-D) sequence covalently attached to a second human IL-10(A-D) sequence and the second protein domain comprises a first human IL-10 (E-F) sequence covalently attached to a second human IL-10(E-F) sequence. In some embodiments, the first protein domain is covalently attached to the C-terminus of the first Fc domain and the second protein domain is covalently attached to the C-terminus of the second Fc domain. In some embodiments, the first antigen binding domain is covalently attached to the N-terminus of the first Fc domain and the first protein domain is covalently attached to the N-terminus of the first antigen binding domain, and wherein the second antigen binding domain is covalently attached to the N-terminus of the second Fc domain and the second protein domain is covalently attached to the N-terminus of the second antigen binding domain. In some embodiments, the first protein domain is covalently attached to the N-terminus of the first Fc domain and the second protein domain is covalently attached to the N-terminus of the second Fc domain, and wherein the first antigen binding domain is covalently attached to the N-terminus of the first protein domain and the second antigen binding domain is covalently attached to the N-terminus of the second protein domain.

In some embodiments of the mAb-IL10 format, the dimeric Fc fusion protein comprises: (a) a first fusion protein comprising a first IL-10 monomer domain, a first Fc domain, and a first antigen binding domain, wherein the first IL-10 monomer domain is covalently attached to the C-terminus of the first Fc domain, and the first antigen binding domain is covalently attached to the N-terminus of the first Fc domain; and (b) a second fusion protein comprising a second IL-10 monomer domain, a second Fc domain, and a second antigen binding domain, wherein the second IL-10 monomer domain is covalently attached to the C-terminus of the second Fc domain, and the second antigen binding domain is covalently attached to the N-terminus of the second Fc domain. In some embodiments, the first IL-10 monomer domain is attached to the first Fc domain using a first domain linker and/or the second IL-10 monomer domain is attached to the second Fc domain using a second domain linker. In some embodiments, the first antigen binding domain is attached to the first Fc domain using a third domain linker and/or the second antigen binding domain is attached to the second Fc domain using a fourth domain linker. In some embodiments, the first Fc domain and/or second Fc domain comprise a further amino acid substitution selected from the group consisting of M428L, N434S, and M428L/N434S, according to EU numbering. In some embodiments, the first and/or the second IL-10 monomer domain comprises a leucine at position 109. In some embodiments, the first and/or the second IL-10 monomer domain comprises a polypeptide sequence selected from the group consisting of SEQ ID NO:1 (human IL-10 (109H) precursor sequence), SEQ ID NO:2 (human IL-10 (109L) precursor sequence), SEQ ID NO:3 (human IL-10 (109H) mature form sequence), SEQ ID NO:4 (human IL-10 (109L) mature form sequence). In some embodiments, the first IL-10 monomer domain and/or the second IL-10 monomer domain is a variant IL-10 monomer domain. In some embodiments, the variant IL-10 monomer domain comprises an IL-10 monomer domain with one or more amino acid substitutions resulting in altered affinity for an IL-10 receptor, altered potency, altered potential for deamidation, altered potential for aspartic acid isomerization, altered potential for degradation-related PTMs, altered potential degradation sites, altered disulfide bridges, and/or altered potential N-glycosylation sites. In some embodiments, the variant IL-10 monomer domain comprises one or more amino acid modifications at amino acid residues selected from the group consisting of N21, D28, Q38, M39, D41, Q42, L43, D44, N45, I87, E142, D144, and E151. In some embodiments, the variant IL-10 monomer domain comprises one or more amino acid modifications selected from the group consisting of N21D, D28N, Q38E, M39T, D41N, Q42E, L43V, D44N, N45D, I87A, E142Q, D144N, and E151Q.

In some embodiments of the IL10mAb format, the dimeric Fc fusion protein comprises: (a) a first fusion protein comprising a first IL-10 monomer domain, a first Fc domain, and a first antigen binding domain, wherein the first IL-10 monomer domain is covalently attached to the first antigen binding domain and the first antigen binding domain is further covalently attached to the N-terminus of the first Fc domain; and (b) a second fusion protein comprising a second IL-10 monomer domain, a second Fc domain, and a second antigen binding domain, wherein the second IL-10 monomer domain is covalently attached to the second antigen binding domain and the second antigen binding domain is covalently attached to the N-terminus of the second Fc domain. In some embodiments, the first IL-10 monomer domain is attached to the first antigen binding domain using a first domain linker and/or the second IL-10 monomer domain is attached to the second antigen binding domain using a second domain linker. In some embodiments, the first antigen binding domain is attached to the first Fc domain using a third domain linker and/or the second antigen binding domain is attached to the second Fc domain using a fourth domain linker. In some embodiments, the first and/or second Fc domains comprise a further amino acid substitution selected from the group consisting of M428L, N434S, and M428L/N434S, according to EU numbering. In some embodiments, the first and/or the second IL-10 monomer domain comprises a histidine at position 109. In some embodiments, the first and/or the second IL-10 monomer domain comprises a leucine at position 109. In some embodiments, the first and/or the second IL-10 monomer domain comprises a polypeptide sequence selected from the group consisting of SEQ ID NO:1 (human IL-10 (109H) precursor sequence), SEQ ID NO:2 (human IL-10 (109L) precursor sequence), SEQ ID NO:3 (human IL-10 (109H) mature form sequence), SEQ ID NO:4 (human IL-10 (109L) mature form sequence). In some embodiments, the first IL-10 monomer domain and/or the second IL-10 monomer domain is a variant IL-10 monomer domain. In some embodiments, the variant IL-10 monomer domain comprises an IL-10 monomer domain with one or more amino acid substitutions resulting in altered affinity for an IL-10 receptor, altered potency, altered potential for deamidation, altered potential for aspartic acid isomerization, altered potential for degradation-related PTMs, altered potential degradation sites, altered disulfide bridges, and/or altered potential N-glycosylation sites. In some embodiments, the variant IL-10 monomer domain comprises one or more amino acid modifications at amino acid residues selected from the group consisting of N21, D28, Q38, M39, D41, Q42, L43, D44, N45, I87, E142, D144, and E151. In some embodiments, the variant IL-10 monomer domain comprises one or more amino acid modifications selected from the group consisting of N21D, D28N, Q38E, M39T, D41N, Q42E, L43V, D44N, N45D, I87A, E142Q, D144N, and E151Q.

In some embodiments of the mAb-central-IL10 format, the dimeric Fc fusion protein comprises: (a) a first fusion protein comprising a first IL-10 monomer domain, a first Fc domain, and a first antigen binding domain, wherein the first IL-10 monomer domain is covalently attached to the first antigen binding domain and the first IL-10 monomer domain is further covalently attached to the N-terminus of the first Fc domain; and (b) a second fusion protein comprising a second IL-10 monomer domain, a second Fc domain, and a second antigen binding domain, wherein the second IL-10 monomer domain is covalently attached to the second antigen binding domain and the second IL-10 monomer domain is covalently attached to the N-terminus of the second Fc domain.

In some embodiments, the first IL-10 monomer domain is attached to the first antigen binding domain using a first domain linker and/or the second IL-10 monomer domain is attached to the second antigen binding domain using a second domain linker. In some embodiments, the first IL-10 monomer domain is attached to the first Fc domain using a third domain linker and/or the second IL-10 monomer domain is attached to the second Fc domain using a fourth domain linker. In some embodiments, the first and/or second Fc domains comprise a further amino acid substitution selected from the group consisting of M428L, N434S, and M428L/N434S, according to EU numbering. In some embodiments, the first and/or the second IL-10 monomer domain comprises a histidine at position 109. In some embodiments, the first and/or the second IL-10 monomer domain comprises a leucine at position 109. In some embodiments, the first and/or the second IL-10 monomer domain comprises a polypeptide sequence selected from the group consisting of SEQ ID NO:1 (human IL-10 (109H) precursor sequence), SEQ ID NO:2 (human IL-10 (109L) precursor sequence), SEQ ID NO:3 (human IL-10 (109H) mature form sequence), SEQ ID NO:4 (human IL-10 (109L) mature form sequence). In some embodiments, the first IL-10 monomer domain and/or the second IL-10 monomer domain is a variant IL-10 monomer domain. In some embodiments, the variant IL-10 monomer domain comprises an IL-10 monomer domain with one or more amino acid substitutions resulting in altered affinity for an IL-10 receptor, altered potency, altered potential for deamidation, altered potential for aspartic acid isomerization, altered potential for degradation-related PTMs, altered potential degradation sites, altered disulfide bridges, and/or altered potential N-glycosylation sites. the variant IL-10 monomer domain comprises one or more amino acid modifications at amino acid residues selected from the group consisting of N21, D28, Q38, M39, D41, Q42, L43, D44, N45, I87, E142, D144, and E151. In some embodiments, the variant IL-10 monomer domain comprises one or more amino acid modifications selected from the group consisting of N21D, D28N, Q38E, M39T, D41N, Q42E, L43V, D44N, N45D, I87A, E142Q, D144N, and E151Q.

As will be appreciated, the antigen binding domain for any of the formats described herein, including those illustrated in the figures including but not limited to FIGS. 87A-87D, FIGS. 88A-88E, FIGS. 89A-89M, and FIGS. 90A-90H may be directed to any suitable antigen, including without limitation CD8, NKG2D, PD-1, and TIGIT. In some embodiments, any of antigen binding domain (e.g., a first and/or a second antigen binding domain) described herein that binds CD8 is incorporated into a targeted IL-10 fusion protein format. The sequence of exemplary CD8 ABDs are provided in FIG. 92 and the sequence listing. In some embodiments, any of antigen binding domain (e.g., a first and/or a second antigen binding domain) described herein that binds NKG2D is incorporated into a targeted format. Sequences of exemplary NKG2D ABDs are provided in FIGS. 93A-93C and the sequence listing. In some embodiments, any of antigen binding domain (e.g., a first and/or a second antigen binding domain) described herein that binds PD-1 is incorporated into a targeted format. Sequences of exemplary PD-1 ABDs are provided in FIGS. 100A-100G and the sequence listing. Sequences of exemplary non-competing PD-1 ABDs are provided in FIGS. 104A-104B and the sequence listing. In some embodiments, any of antigen binding domain (e.g., a first and/or a second antigen binding domain) described herein that binds TIGIT is incorporated into a targeted format. Sequences of exemplary TIGIT ABDs are provided in FIGS. 122A-122C and the sequence listing.

In another aspect of the targeted formats described herein, any of the IL-10 monomer domains (e.g., the variant IL-10 monomer domain) described herein (e.g., those shown in FIGS. 55, 57, 64, 67, 70A-70B, and 73, and the corresponding SEQ ID NOs) are useful for an applicable targeted IL-10 fusion protein format. In some embodiments, any of the hIL-10(A-D) and hIL-10(E-F) sequences including but not limited to SEQ ID NO:21 and 22, respectively of a splitIL10 and he hIL-10(A-D) and hIL-10(E-F) variants described herein (e.g., those shown in FIGS. 55, 57, 64, 67, 70A-70B, and 73, and the corresponding SEQ ID NOs) are useful in a targeted IL-10 fusion protein format. In certain embodiments, any of the IL10M1 sequences including but not limited to SEQ ID NO:24 and the IL10M1 variants described herein (e.g., those shown in FIGS. 36A-36E, 55, 57, 64, 67, 70A-70B, 71A-71E, 73, 74A-74B, 75A-75B, and 76A-76D, and the corresponding SEQ ID NOs) are useful in a targeted IL-10 fusion protein format. In some embodiments, any of the IL10M1 sequences comprise an amino acid sequence having at least 90% (e.g., at least 90%, 91%, 92%, 93%, 94%, 95%, 96%, 97%, 98%, 99%, or more) sequence identity to SEQ ID NO:24. In some embodiments, any of the scIL10 sequences including but not limited to SEQ ID NO:23 and the scIL10 variants described herein (e.g., those shown in FIGS. 21A-21C, 22, 35A-35D, 39A-39G, 40A-40M, 41A-41F, 48, 49A-49B, 53, 55, 56A-56C, 58, 59A-59H, 60, 64, 65A-65B, 66A-66D, 67, 68, 69, 70A-70B, 73, 78A-78G, 79A-79G, and 86A-86D, and the corresponding SEQ ID NOs) are useful in a targeted IL-10 fusion protein format. In some embodiments, any of the scIL10 sequences comprise an amino acid sequence having at least 90% (e.g., at least 90%, 91%, 92%, 93%, 94%, 95%, 96%, 97%, 98%, 99%, or more) sequence identity to SEQ ID NO:23.

In one aspect, provided herein is a composition comprising any one of the heterodimeric Fc fusion proteins or dimeric fusion proteins outlined herein including the figures for use in treating cancer in a subject. Also provided is one or more nucleic acids encoding such a heterodimeric Fc fusion protein or dimeric fusion protein. Also provided is a host cell comprising one or more of such nucleic acids encoding a heterodimeric Fc fusion protein or dimeric fusion protein described herein.

In another aspect, provided herein is a method of producing any of the heterodimeric Fc fusion proteins or dimeric fusion proteins described. In some embodiments, the method comprises culturing any of the host cells outlined herein under conditions whereby the heterodimeric Fc fusion protein or dimeric fusion protein is produced; and recovering the protein.

VIII. Useful Embodiments of the Invention

As will be appreciated by those in the art and discussed more fully below, the untargeted IL-10 fusion proteins of the present invention can take on a wide variety of configurations, as are generally depicted in the figures including, but not limited to, FIGS. 16A-16D, 20A-20B, 23A-23F, and 29A-29D. The targeted IL-10 fusion proteins of the present invention can take on a wide variety of configurations, as are generally depicted in the figures including, but not limited to, FIGS. 87A-87D, 88A-88D, 89A-89M, and 90A-90H.

In one embodiment of the invention is the scIL10-heteroFc format depicted in FIG. 20A with IL-10 variants and/or amino acid substitutions in the Fc domain. In general, such a format comprises a first monomer/fusion protein comprising an scIL-10 covalently attached to the N-terminus of a first heterodimeric Fc chain (optionally via a domain linker) and a second monomer/fusion protein comprising a complementary second heterodimeric Fc chain that is "Fc-only" or "empty-Fc". In such an embodiment, the scIL-10 comprises a first IL-10 monomer domain attached to a second IL-10 monomer domain.

In further embodiments, the Fc fusion proteins in this exemplary format have the sequences set forth in FIGS. 78B, 78C, and 78F for XENP30005 (SEQ ID NOS:25 and 26), XENP30008 (SEQ ID NOS: 27 and 28) or XENP30013 (SEQ ID NOS: 29 and 30), respectively. In still further embodiments, the Fc fusion proteins in this exemplary format comprise the sequences set forth in FIGS. 78B, 78C, and 78F for XENP30005 (SEQ ID NOS:25 and 26), XENP30008 (SEQ ID NOS: 27 and 28) or XENP30013 (SEQ ID NOS: 29 and 30), respectively with the additional amino acid modifications selected from the group (singly or in any combination): G445del, K447del, G445del/K447del, M428L, N434S, and M428L/N434S, according to EU numbering.

In some embodiments, the scIL10-heteroFc format fusion protein of the invention comprises an IL-10 monomer comprising any of the human IL10 precursor or mature sequences (109H or 109L) depicted in FIG. 1 within the scIL10-heteroFc format depicted in FIG. 20A. In further embodiments, the IL-10 monomer comprises IL-10 monomer variants designed with the aim to reduce their affinity for the IL-10 receptor complex and/or to reduce their potency. In such affinity/potency variants, variant IL-10 monomers may contain one or more substitutions at positions selected from: N21, D28, Q38, M39, D41, Q42, L43, D44, N45, I87, E142, D144, and E151, singly or in any combination. Exemplary sequences for variant IL-10 monomers are shown in FIGS. 35A-35C—as will be appreciated, although the sequences depicted are in the context of the IL-10 (109L) sequence, the same substitutions can be made in the context of the IL-10(109H) sequence. Any of the sequences depicted in FIGS. 35A-35C can be used in the context of the scIL10-heteroFc format depicted in FIG. 20A.

In some embodiments, the scIL10-heteroFc format fusion protein of the present invention includes modifications in the Fc domain that improve manufacturability. In further embodiments, the scIL10-heteroFc format fusion protein of the invention includes the G446del/K4447del modification in the Fc region of one or both Fc domains. In further embodiments, the scIL10-heteroFc format fusion protein of the invention includes both the G446del/K4447del modification and the M428L/N434S modification in one or both of the Fc domains.

In further embodiments, the scIL10-heteroFc format fusion protein of the present invention includes domain linkers between the first and second IL-10 monomer domain and/or between the scIL10 and the Fc domain. In still further embodiments, the domain linker used is selected from those pictured in the figures. In yet further embodiments, the scIL-10 complexes comprising domain linkers between the first IL-10 monomer and the second IL-10 monomer includes sequences as depicted in FIG. 48, including SEQ ID NO: 367 (scIL-10($G_4S$)), SEQ ID NO: 368 (scIL-10 ($G_4S$)$_2$), or SEQ ID NO: 369 (scIL-10($G_4S$)$_3$).

In still further embodiments, scIL10-heteroFc format fusion protein of the present invention comprising domain linkers between the first and second IL-10 monomers have sequences as depicted in FIGS. 49A-49B. In yet further embodiments, the proteins are selected from XENP25239, XENP25240, and XENP25241.

Figures 87A, 87B, 87C, 87D:
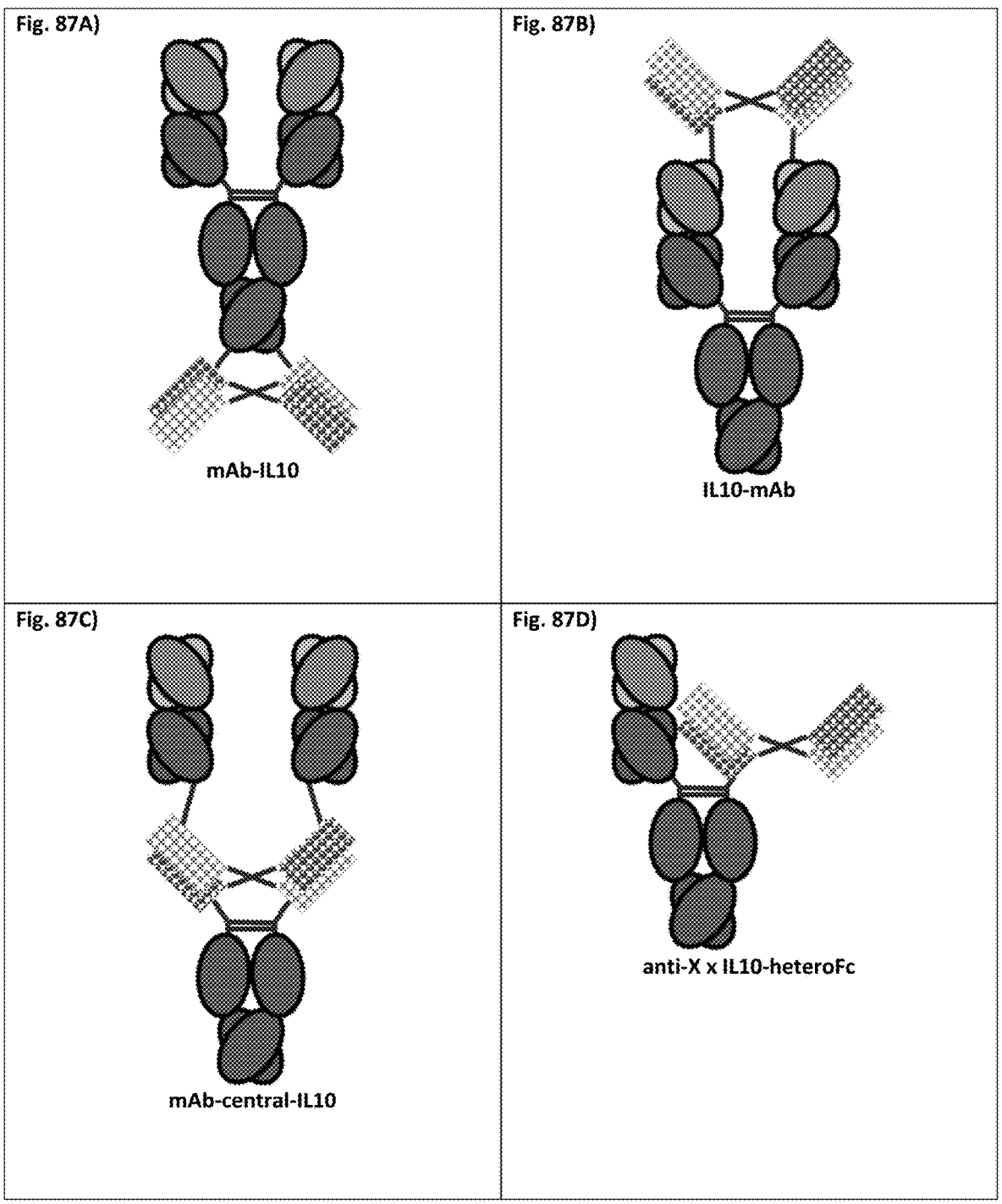
Figures 88A, 88B, 88C, 88D:
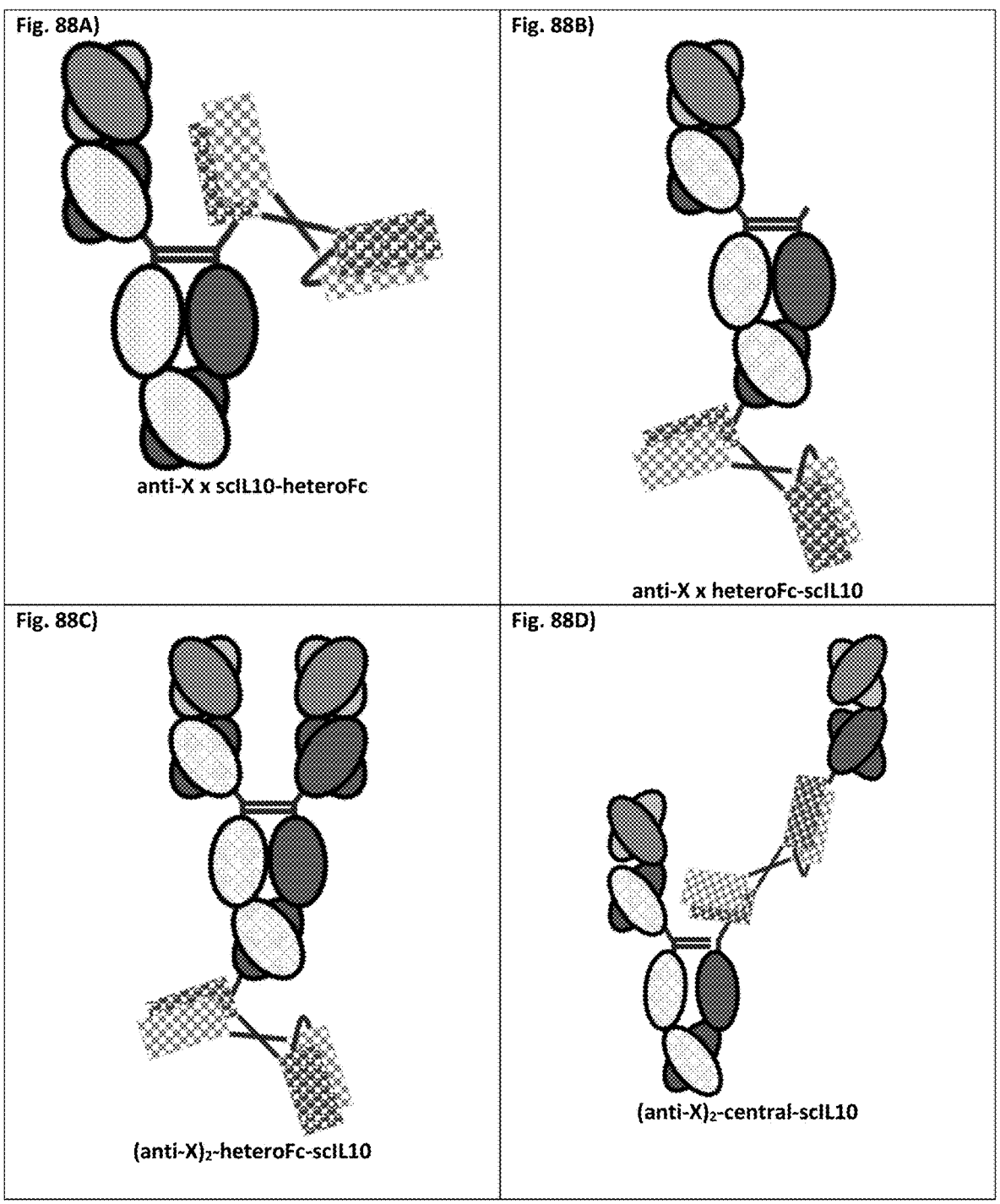
Figure 88E:
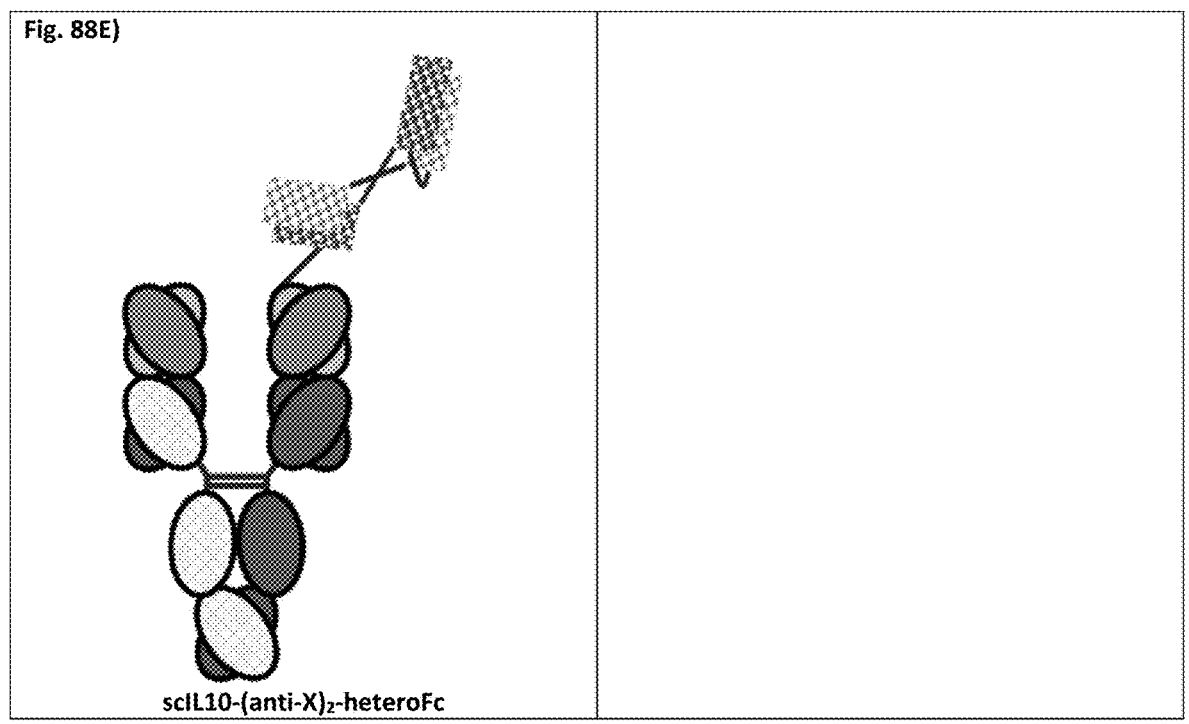

In one aspect, the present invention provides IL-10 fusion proteins in the "anti-XxscIL10-heteroFc" format pictured in FIG. 87A, which comprises a first fusion protein comprising an antigen-binding domain covalently linked to the N-terminus of a first heterodimeric Fc chain and a second fusion protein comprising a scIL-10 covalently attached to the N-terminus of a second heterodimeric Fc chain (optionally via a domain linker).

In one embodiment, the antigen-binding domain used in the anti-XxscIL10-heteroFc format is directed to a target including without limitation CD8, NKG2D, PD-1, and TIGIT.

In embodiments of the anti-XxscIL10-heteroFc format in which the anti-X (antigen binding domain) binds to PD-1, illustrative sequences for such formats are provided in FIGS. 98-100G. In further embodiments, the PD-1 ABD sequence used in the anti-XxscIL10-heteroFc format is a humanized anti-PD1 ABD. In still further embodiments, the humanized anti-PD1 ABD comprises a variable heavy chain sequence according to any set forth in FIGS. 100A-100G and the sequence listing for the corresponding SEQ ID NOS. In yet further embodiments, the humanized anti-PD1 ABD comprises a variable light chain sequence according to any set forth in FIGS. 100A-100G and the sequence listing for the corresponding SEQ ID NOS. In some embodiments, the humanized anti-PD1 ABD comprises a variable heavy chain sequence and a variable light chain sequence according to any set forth in FIGS. 100A-100G and the sequence listing for the corresponding SEQ ID NOS. In still further embodiments, the humanized non-competing anti-PD1 ABD comprises a variable heavy chain sequence according to any set forth in FIGS. 104A-104B and the sequence listing for the corresponding SEQ ID NOS. In yet further embodiments, the humanized non-competing anti-PD1 ABD comprises a variable light chain sequence according to any set forth in FIGS. 104A-104B and the sequence listing for the corresponding SEQ ID NOS. In some embodiments, the humanized non-competing anti-PD1 ABD comprises a variable heavy chain sequence and a variable light chain sequence according to any set forth in FIGS. 104A-104B and the sequence listing for the corresponding SEQ ID NOS. In further embodiments, the humanized non-competing anti-PD1 ABD is combined in the anti-XxscIL10-heteroFc format with either or both the first and second Fc domains containing the M428L/N434S modification. In still further embodiments, the humanized anti-PD1 is combined in the anti-XxscIL10-heteroFc format with either or both the first and second Fc domains containing the M428L/N434S modification. In yet further embodiments, the anti-XxscIL10-heteroFc format fusion proteins of the invention are XENP25953, XENP27830, and XENP27831.

In embodiments of the anti-XxscIL10-heteroFc format in which the anti-X (antigen binding domain) binds to TIGIT, illustrative sequences for such formats are provided in FIGS. 98-100G. In some embodiments, the TIGIT ABD sequence used in the anti-XxscIL10-heteroFc format is a humanized anti-TIGIT ABD. In still further embodiments, the humanized anti-TIGIT ABD comprises a variable heavy chain sequence according to any set forth in FIGS. 122A-122C and the sequence listing for the corresponding SEQ ID NOS. In yet further embodiments, the humanized anti-TIGIT ABD comprises a variable light chain sequence according to any set forth in FIGS. 122A-122C and the sequence listing for the corresponding SEQ ID NOS. In some embodiments, the humanized anti-TIGIT ABD comprises a variable heavy chain sequence and a variable light chain sequence according to any set forth in FIGS. 122A-122C and the sequence listing for the corresponding SEQ ID NOS. In further embodiments, the humanized anti-TIGIT ABD is combined in the anti-XxscIL10-heteroFc format with either or both the first and second Fc domains containing the M428L/N434S modification. In yet further embodiments, the anti-Xx scIL10-heteroFc format fusion proteins of the invention are XENP30523, XENP30524, and XENP30525.

In embodiments of the anti-XxscIL10-heteroFc format in which the anti-X (antigen binding domain) binds to CD8, illustrative sequences for such formats are provided in FIGS. 98-100G. In some embodiments, the CD8 ABD sequence used in the anti-XxscIL10-heteroFc format is a humanized anti-CD8 ABD. In still further embodiments, the humanized anti-CD8 ABD comprises a variable heavy chain sequence according to any set forth in FIG. 92 and the sequence listing for the corresponding SEQ ID NOS. In yet further embodiments, the humanized anti-CD8 ABD comprises a variable light chain sequence according to any set forth in FIG. 92 and the sequence listing for the corresponding SEQ ID NOS. In some embodiments, the humanized anti-CD8 ABD comprises a variable heavy chain sequence and a variable light chain sequence according to any set forth in FIG. 92 and the sequence listing for the corresponding SEQ ID NOS. In further embodiments, the humanized anti-CD8 ABD is combined in the anti-XxscIL10-heteroFc format with either or both the first and second Fc domains containing the M428L/N434S modification. In yet further embodiments, the anti-XxscIL10-heteroFc format fusion proteins of the invention are XENP25365, XENP25366, and XENP30525.

In embodiments of the anti-XxscIL10-heteroFc format in which the anti-X (antigen binding domain) binds to NKG2D, illustrative sequences for such formats are provided in FIGS. 98-100G. In some embodiments, the NKG2D ABD sequence used in the anti-XxscIL10-heteroFc format is a humanized anti-NKG2D ABD. In still further embodiments, the humanized anti-NKG2D ABD comprises a variable heavy chain sequence according to any set forth in FIGS. 93A-93C and the sequence listing for the corresponding SEQ ID NOS. In yet further embodiments, the humanized anti-NKG2D ABD comprises a variable light chain sequence according to any set forth in FIGS. 93A-93C and the sequence listing for the corresponding SEQ ID NOS. In some embodiments, the humanized anti-NKG2D ABD comprises a variable heavy chain sequence and a variable light chain sequence according to any set forth in FIGS. 93A-93C and the sequence listing for the corresponding SEQ ID NOS. In further embodiments, the humanized anti-NKG2D ABD is combined in the anti-X×scIL10-heteroFc format with either or both the first and second Fc domains containing the M428L/N434S modification. In yet further embodiments, the anti-X×scIL10-heteroFc format fusion proteins of the invention are XENP25953, XENP30526, XENP30527, XENP30528, and XENP31819.

IX. Nucleic Acids of the Invention

The invention further provides nucleic acid compositions encoding the Fc fusion proteins, the IL-10 monomer domains, and the IL-10 dimeric complexes of the invention (or, in the case of a monomer Fc domain protein, nucleic acids encoding those as well).

As will be appreciated by those in the art, the nucleic acid compositions will depend on the format of the fusion protein. Thus, for example, when the format requires three amino acid sequences, three nucleic acid sequences can be incorporated into one or more expression vectors for expression. Similarly for some formats, only two nucleic acids are needed; again, they can be put into one or two expression vectors.

As is known in the art, the nucleic acids encoding the components of the invention can be incorporated into expression vectors as is known in the art, and depending on the host cells used to produce the heterodimeric Fc fusion proteins of the invention. Generally the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the invention are then transformed into any number of different types of host cells as is well known in the art, including mammalian, bacterial, yeast, insect and/or fungal cells, with mammalian cells (e.g. CHO cells), finding use in many embodiments.

In some embodiments, nucleic acids encoding each monomer, as applicable depending on the format, are each contained within a single expression vector, generally under different or the same promoter controls. In embodiments of particular use in the present invention, each of these two or three nucleic acids are contained on a different expression vector.

The Fc fusion protein of the invention are made by culturing host cells comprising the expression vector(s) as is well known in the art. Once produced, traditional fusion protein or antibody purification steps are done, including an ion exchange chromatography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that each monomer has a different pI and the heterodimer also has a distinct pI, thus facilitating isoelectric purification of the heterodimer (e.g., anionic exchange chromatography, cationic exchange chromatography). These substitutions also aid in the determination and monitoring of any contaminating homodimers post-purification (e.g., IEF gels, cIEF, and analytical IEX columns).

X. Biological and Biochemical Functionality of IL-10 Immunomodulatory Fc Fusion Proteins Generally the Fc fusion proteins of the invention are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays. For example, evaluation of changes in immune status (e.g., presence of ICOS+CD4+ T cells following ipi treatment) along with "old fashioned" measurements such as tumor burden, size, invasiveness, LN involvement, metastasis, etc. can be done. Thus, any or all of the following can be evaluated: the inhibitory effects of PVRIG on $CD4^+$ T cell activation or proliferation, $CD8^+$ T (CTL) cell activation or proliferation, $CD8^+$ T cell-mediated cytotoxic activity and/or CTL mediated cell depletion, NK cell activity and NK mediated cell depletion, the potentiating effects of PVRIG on Treg cell differentiation and proliferation and Treg- or myeloid derived suppressor cell (MDSC)-mediated immunosuppression or immune tolerance, and/or the effects of PVRIG on proinflammatory cytokine production by immune cells, e.g., IL-2, IFN-γ or TNF-α production by T or other immune cells.

In some embodiments, assessment of treatment is done by evaluating immune cell proliferation, using for example, CFSE dilution method, Ki67 intracellular staining of immune effector cells, and $^3$H-thymidine incorporation method, In some embodiments, assessment of treatment is done by evaluating the increase in gene expression or increased protein levels of activation-associated markers, including one or more of: CD25, CD69, CD137, ICOS, PD1, GITR, OX40, and cell degranulation measured by surface expression of CD107A.

In general, gene expression assays are done as is known in the art.

In general, protein expression measurements are also similarly done as is known in the art.

In some embodiments, assessment of treatment is done by assessing cytotoxic activity measured by target cell viability detection via estimating numerous cell parameters such as enzyme activity (including protease activity), cell membrane permeability, cell adherence, ATP production, co-enzyme production, and nucleotide uptake activity. Specific examples of these assays include, but are not limited to, Trypan Blue or PI staining, $^{51}$Cr or $^{35}$S release method, LDH activity, MTT and/or WST assays, Calcein-AM assay, Luminescent based assay, and others.

In some embodiments, assessment of treatment is done by assessing T cell activity measured by cytokine production, measure either intracellularly in culture supernatant using cytokines including, but not limited to, IFNγ, TNFα, GM-CSF, IL2, IL6, IL4, IL5, IL10, IL13 using well known techniques.

Accordingly, assessment of treatment can be done using assays that evaluate one or more of the following: (i) increases in immune response, (ii) increases in activation of αβ and/or γδ T cells, (iii) increases in cytotoxic T cell activity, (iv) increases in NK and/or NKT cell activity, (v) alleviation of αβ and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases or eliminates cell number and/or activity of at least one of regulatory T cells (Tregs).

A. Assays to Measure Efficacy and Potency

In some embodiments, T cell activation is assessed using a Mixed Lymphocyte Reaction (MLR) assay as is known in the art. An increase in activity indicates immunostimulatory activity. Appropriate increases in activity are outlined below.

In one embodiment, the signaling pathway assay measures increases or decreases in immune response as measured for an example by phosphorylation or de-phosphorylation of different factors, or by measuring other post translational modifications. IL-12 mediates IFNγ expression and secretion through phosphorylation of STAT4 (Morinobu et al., 2002). Accordingly, in a preferred embodiment, the signaling pathway assay measures increases or decreases in immune response as indicated by phosphorylation of STAT4. An increase in activity indicates immunostimulatory activity. Appropriate increases in activity are outlined below.

In one embodiment, the signaling pathway assay measures increases or decreases in activation of αβ and/or γδ T cells as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in cytotoxic T cell activity as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in NK and/or NKT cell activity as measured for an example by direct killing of target cells like for an example cancer cells or by cytokine secretion or by changes in expression of activation markers like for an example CD107a, etc. An increase in activity indicates immunostimulatory activity. Appropriate increases in activity are outlined below.

In one embodiment, the signaling pathway assay measures increases or decreases in αβ and/or γδ T-cell suppression, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in pro-inflammatory cytokine secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in IL-2 secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in interferon-γ production as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in Th1 response as measured for an example by cytokine secretion or by changes in expression of activation markers. An increase in activity indicates immunostimulatory activity. Appropriate increases in activity are outlined below.

In one embodiment, the signaling pathway assay measures increases or decreases in Th2 response as measured for an example by cytokine secretion or by changes in expression of activation markers. An increase in activity indicates immunostimulatory activity. Appropriate increases in activity are outlined below.

In one embodiment, the signaling pathway assay measures increases or decreases cell number and/or activity of at least one of regulatory T cells (Tregs), as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophages cell numbers, as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophage pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in N2 neutrophils increase, as measured for example by flow cytometry or by IHC. A decrease in response indicates immunostimulatory activity. Appropriate decreases are the same as for increases, outlined below.

In one embodiment, the signaling pathway assay measures increases or decreases in N2 neutrophils pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in inhibition of T cell activation, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in inhibition of CTL activation as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in αβ and/or γδ T cell exhaustion as measured for an example by changes in expression of activation markers. A decrease in response indicates immunostimulatory activity. Appropriate decreases are the same as for increases, outlined below.

In one embodiment, the signaling pathway assay measures increases or decreases αβ and/or γδ T cell response as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in stimulation of antigen-specific memory responses as measured for an example by cytokine secretion or by proliferation or by changes in expression of activation markers like for an example CD45RA, CCR7 etc. An increase in activity indicates immunostimulatory activity. Appropriate increases in activity are outlined below.

In one embodiment, the signaling pathway assay measures increases or decreases in apoptosis or lysis of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases in stimulation of cytotoxic or cytostatic effect on cancer cells, as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases direct killing of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases Th17 activity as measured for an example by cytokine secretion or by proliferation or by changes in expression of activation markers. An increase in activity indicates immunostimulatory activity. Appropriate increases in activity are outlined below.

In one embodiment, the signaling pathway assay measures increases or decreases in induction of complement dependent cytotoxicity and/or antibody dependent cell-mediated cytotoxicity, as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, T cell activation is measured for an example by direct killing of target cells like for an example cancer cells or by cytokine secretion or by changes in expression of activation markers like for an example CD137, CD107a, PD1, etc. For T-cells, increases in proliferation, cell surface markers of activation (e.g., CD25, CD69, CD137, PD1), cytotoxicity (ability to kill target cells), and cytokine production (e.g., IL-2, IL-4, IL-6, IFNγ, TNF-α, IL-10, IL-17A) would be indicative of immune modulation that would be consistent with enhanced killing of cancer cells.

In one embodiment, NK cell activation is measured for example by direct killing of target cells like for an example cancer cells or by cytokine secretion or by changes in expression of activation markers like for an example CD107a, etc. For NK cells, increases in proliferation, cytotoxicity (ability to kill target cells and increases CD107a, granzyme, and perforin expression), cytokine production (e.g., IFNγ and TNF), and cell surface receptor expression (e.g. CD25) would be indicative of immune modulation that would be consistent with enhanced killing of cancer cells.

In one embodiment, γδ T cell activation is measured for example by cytokine secretion or by proliferation or by changes in expression of activation markers.

In one embodiment, Th1 cell activation is measured for example by cytokine secretion or by changes in expression of activation markers.

Appropriate increases in activity or response (or decreases, as appropriate as outlined above), are increases of 10%, 20%, 30%, 40%, 50%, 60%, 70%, 80%, 90%, 95% or 98 to 99% percent over the signal in either a reference sample or in control samples, for example test samples that do not contain an IL-12 heterodimeric fusion protein of the invention. Similarly, increases of at least one-, two-, three-, four- or five-fold as compared to reference or control samples show efficacy.

XI. Treatments

Once made, the compositions of the invention find use in a number of oncology applications, by treating cancer, generally by promoting T cell activation (e.g., T cells are no longer suppressed) with the binding of the heterodimeric Fc fusion proteins of the invention.

Accordingly, the heterodimeric compositions of the invention find use in the treatment of these cancers.

A. Fusion Protein Compositions for In Vivo Administration

Formulations of the fusion proteins used in accordance with the present invention are prepared for storage by mixing a fusion protein having the desired degree of purity with optional pharmaceutically acceptable carriers, excipients or stabilizers (as generally outlined in Remington's Pharmaceutical Sciences 16th edition, Osol, A. Ed. [1980]), in the form of lyophilized formulations or aqueous solutions. Acceptable carriers, buffers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN™, PLURONICS™ or polyethylene glycol (PEG).

B. Administrative Modalities

The fusion proteins and chemotherapeutic agents of the invention are administered to a subject, in accord with known methods, such as intravenous administration as a bolus or by continuous infusion over a period of time.

C. Treatment Modalities

In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the protein or protein portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the heterodimeric proteins used in the present invention depend on the disease or condition to be treated and may be determined by the persons skilled in the art.

An exemplary, non-limiting range for a therapeutically effective amount of an heterodimeric proteins used in the present invention is about 0.1-100 mg/kg.

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Examples are provided below to illustrate the present invention. These examples are not meant to constrain the present invention to any particular application or theory of operation. For all constant region positions discussed in the present invention, numbering is according to the EU index as in Kabat (Kabat et al., 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

General and specific scientific techniques are outlined in US Publications 2015/0307629, 2014/0288275 and WO2014/145806, all of which are expressly incorporated by reference in their entirety and particularly for the techniques outlined therein.

Example 1: Engineering IL-10 Fusion Proteins

As described above, cytokines such as IL-10 have short half-life, and high dose treatment is required to achieve a concentration of cytokines at the target (e.g. tumor site) sufficient to induce an immune response. However, based on observations with other cytokines, high dose treatment with IL-10 could potentially result in systemic toxicities. Further, the native IL-10 monomer is biologically inactive, and the biologically active IL-10 dimer becomes inactive upon disruption of the interactions between the two monomer units. In order to address these two caveats, we engineered various IL-10 formats as Fc fusion proteins (collectively referred to hereon as IL-10 fusion proteins or IL-10 fusions) with the aim both to promote a biologically active IL-10 and to enhance serum half-life through FcRn-mediated recycling.

1A: IL-10 Fusion Protein Formats

As described above, the biologically active IL-10 is a domain-swapped homodimer formed by non-covalent interactions between two IL-10 monomers. Each IL-10 monomer is composed of 6 helices, herein referred to as helices A-F. It has been previously reported that the non-covalent interaction that forms the biologically active IL-10 homodimer results from domain swapping between helices A-D (or "hIL-10(A-D)"; residues 1-116 of the mature form IL-10) of a first IL-10 monomer and helices E-F (or "hIL-10(E-F)"; residues 117-160 of the mature form IL-10) of a second IL-10 monomer. Here, we describe four categories of IL-10 fusion proteins engineered with the aim to either retain the dimeric nature of IL-10 or with the aim to circumvent the requirement for domain swapping between IL-10 monomers.

1A(a): IL10-Fc Fusions

Towards engineering an IL-10 fusion protein wherein the IL-10 homodimer is pre-complexed, a first IL-10 fusion category we conceived is the IL10-Fc fusion (cartoon schematics depicted in FIG. 16). One such format of this category we engineered as a prototype is the (IL10)$_2$-Fc format (cartoon schematic depicted in FIG. 16A) which comprises two identical monomers, each monomer comprising an IL-10 monomer covalently attached to the N-terminus of a homodimeric Fc chain. Illustrative proteins of the (IL10)$_2$-Fc format include XENP24628, sequences for which are depicted in FIG. 17. Another format of this category we engineered as a prototype is the Fc-(IL10)$_2$ format (cartoon schematic depicted in FIG. 16B) which comprises two identical monomers, each monomer comprising an IL-10 monomer covalently attached to the C-terminus of a homodimeric Fc chain. Illustrative proteins of the Fc-(IL10)$_2$ format include XENP24632, sequences for which are depicted in FIG. 18. Yet another format of this category we engineered as a prototype is the (IL10-NC-IL10)-heteroFc format (cartoon schematic depicted in FIG. 16C) which comprises a first monomer comprising a first IL-10 monomer covalently attached to the N-terminus of a first heterodimeric Fc chain (optionally via a domain linker) and a second monomer comprising a complementary second heterodimeric Fc chain that is "Fc-only" or "empty-Fc", while a second IL-10 monomer is transfected separately so that a non-covalent IL-10 dimer is formed. Illustrative proteins of the (IL10-NC-IL10)-heteroFc format include XENP25955, sequences for which are depicted in FIG. 19.

1A(b): scIL10-Fc Fusion

Next, we sought to pre-complex the IL-10 homodimer as a single-chain IL-10 complex (or "scIL-10") wherein a first IL-10 monomer is covalently attached to a second IL-10 monomer. We conceived a category of IL-10 fusions utilizing the scIL-10 hereon referred to as scIL10-Fc fusions (cartoon schematics depicted in FIG. 20). One such format of this category we engineered as a prototype is the scIL10-heteroFc format (cartoon schematic depicted in FIG. 20A) which comprises a first monomer comprising a scIL-10 covalently attached to the N-terminus of a first heterodimeric Fc chain and a second monomer comprising a complementary second heterodimeric Fc chain that is "Fc-only" or "empty-Fc". An illustrative proteins of the scIL10-heteroFc format include XENP25880, sequences for which are depicted in FIG. 21. Another such format of this category we engineered as a prototype is the heteroFc-scIL10 format (cartoon schematic depicted in FIG. 20B) which comprises a first monomer comprising a scIL-10 covalently attached to the C-terminus of a first heterodimeric Fc chain (optionally via a domain linker) and a second monomer comprising a complementary second heterodimeric Fc chain that is "Fc-only" or "empty-Fc". An illustrative protein of the heteroFc-scIL10 is XENP28740, sequences for which are depicted in FIG. 22.

1A(c): IL10M1-Fc Fusion

Next, we explored IL-10 fusion formats engineered with the aim to circumvent the requirement for domain swapping between two IL-10 monomers. As discussed above, disruption of the non-covalent interaction which forms the biologically active IL-10 homodimer results in biologically inactive IL-10 monomers. However, Josephson et al. (2000) reported "IL-10M1" (or "IL10M1"; sequence depicted in FIG. 15D) which is a biologically active IL-10 monomer generated by engineering a Gly-Ser linker (GGGSGG (SEQ ID NO: 39)) between helices D and E of an IL-10 monomer. Josephson et al. reported that IL-10M1 is capable of binding IL-10R1 and recruiting IL-10R2 to induce IL-10 cellular responses. Accordingly, we conceived a category of IL-10 fusion proteins utilizing IL10M1 hereon referred to as IL10M1-Fc fusions (cartoon schematics depicted in FIG. 23). One such format of this category we engineered as a prototype is the (IL10M1)$_1$-heteroFc (cartoon schematic depicted in FIG. 23E) which comprises an IL10M1 covalently attached to the N-terminus of a first heterodimeric Fc chain (optionally via a linker), and a second monomer comprising a complementary second heterodimeric Fc chain that is "Fc-only" or "empty-Fc". An illustrative protein of the (IL10M1)$_1$-heteroFc format is XENP14246, sequences for which are depicted in FIG. 24. Another such format of this category we engineered as a prototype is the heteroFc-(IL10M1)$_1$ (cartoon schematic depicted in FIG. 23F) which comprises an IL10M1 covalently attached to the C-terminus of a first heterodimeric Fc chain (optionally via a linker), and a second monomer comprising a complementary second heterodimeric Fc chain that is "Fc-only" or "empty-Fc". An illustrative protein of the heteroFc-(IL10M1)$_1$ format is XENP14247, sequences for which are depicted in FIG. 25. Yet another format of this category we engineered as a prototype is the (IL10M1)$_2$-Fc format (cartoon schematic depicted in FIG. 23A) which comprises two identical monomers, wherein each monomer comprising an IL10M1 covalently attached to the N-terminus of a homodimeric Fc chain. An illustrative protein of the (IL10M1)$_2$-Fc format is XENP25236, sequences for which are depicted in FIG. 26. A further format of this category we engineered as a prototype is the Fc-(IL10M1)$_2$ format (cartoon schematic depicted in FIG. 23B) which comprises two identical monomers, wherein each monomer comprising an IL10M1 covalently attached to the C-terminus of a homodimeric Fc chain. An illustrative protein of the Fc-(IL10M1)$_2$ format is XENP25237, sequences for which are depicted in FIG. 27. Yet a further format of this category we engineered as a prototype is the (IL10M1)$_2$-heteroFc format (cartoon schematic depicted in FIG. 23C) which comprises a first monomer comprising a first IL10M1 covalently attached to a second IL10M1 (optionally via a linker) further covalently attached to the N-terminus of a first heterodimeric Fc chain (optionally via a linker), and a second monomer comprising a complementary second heterodimeric Fc chain that is "Fc-only" or "empty-Fc". An illustrative protein of the (IL10M1)$_2$-heteroFc format is XENP26887, sequences for which are depicted in FIG. 28.

1A(d): splitIL10-Fc Fusions

We reasoned that, instead of utilizing a Gly-Ser linker between IL10(A-D) and IL10(E-F) domains as in IL10M1, a biologically active IL-10 monomer could be generated by "splitting" the IL-10 monomer into its two domains (i.e. hIL-10(A-D) and hIL-10(E-F), sequences for which are depicted respectively in FIGS. 15A-15B), and that dimerization of the IL-10 domains would provide for a biologically active molecule referred to herein as a "splitIL10". Accordingly, we conceived IL-10 fusions utilizing the splitIL10 hereon referred to as splitIL10-Fc fusions (cartoon schematics depicted in FIG. 29). One such format of this category we engineered as a prototype is the splitIL10-heteroFc format (cartoon schematic depicted in FIG. 29A) which comprises a first monomer comprising hIL-10(A-D) covalently attached to the N-terminus of a first heterodimeric Fc chain and a second monomer comprising hIL-10(E-F) covalently attached to the N-terminus of a complementary second heterodimeric Fc chain, so that dimerization of the heterodimeric Fc chains forces dimerization of the IL-10 domains. Illustrative proteins of the splitIL10-heteroFc format include XENP25242, sequences for which are depicted in FIG. 30. Another such format of this category we engineered as a prototype is the heteroFc-splitIL10 format (cartoon schematics depicted in FIG. 29B) which comprises a first monomer comprising a hIL-10(A-D) domain covalently attached to the C-terminus of a first heterodimeric Fc chain (optionally via a linker) and a second monomer comprising a hIL-10(E-F) domain covalently attached the C-terminus of a complementary second heterodimeric Fc chain (optionally via a linker). Illustrative proteins of the heteroFc-splitIL10 format include XENP25879, sequences for which are depicted in FIG. 31.

1B: Production of Prototype IL-10 Fusion Proteins

To produce XENP24628, an illustrative IL-10 fusion protein of the IL10-Fc category, plasmid coding for the IL-10 monomer was constructed by standard gene synthesis, followed by subcloning into a pTT5 expression vector containing an Fc fusion partner (e.g. homodimeric Fc chain as depicted in FIG. 10).

To produce XENP25880, an illustrative IL-10 fusion protein of the scIL10-Fc category, plasmid coding for the scIL-10 complex was constructed by standard gene synthesis, followed by subcloning into a pTT5 expression vector containing an Fc fusion partner (e.g. a first heterodimeric Fc chain as depicted in FIG. 11). An additional pTT5 expression vector coding for an empty-Fc (e.g. a corresponding second heterodimeric Fc chain as depicted in FIG. 11) was also used.

To produce XENP25236, an illustrative IL-10 fusion protein of the IL10M1-Fc category, plasmid coding for the IL10M1 was constructed by standard gene synthesis, followed by subcloning into a pTT5 expression vector containing an Fc fusion partner (e.g. homodimeric Fc chain as depicted in FIG. 10).

To produce XENP25242, an illustrative IL-10 fusion protein of the splitIL10-Fc fusion category, plasmids coding for hIL-10(A-D) and hIL-10(E-F) were constructed by standard gene synthesis, followed by subcloning into pTT5 expression vectors containing Fc fusion partners (e.g. heterodimeric Fc backbones as depicted in FIG. 11).

Proteins were produced by transient transfection in HEK293E cells and were purified by a two-step purification process comprising protein A chromatography (purification part 1) followed by ion exchange chromatography (purification part 2).

1B(a): Purification of IL-10 Fusion Proteins

To illustrate the purification of IL-10 fusion proteins as described above, we describe here the purification and characterization of XENP25880. XENP25880 was purified from HEK293E supernatant as described above. FIG. 32A depicts the chromatogram showing purification part 2 of XENP25880 (cation exchange chromatography following protein A chromatography). The chromatogram shows the isolation of two peaks (peak A and peak B), which were further characterized by analytical size-exclusion chromatography with multi-angle light scattering (aSEC-MALS) and analytical cation-exchange chromatography (aCIEX) for identity, purity and homogeneity as generally described below.

Peaks A and B isolated from purification part 2 for XENP25880 were analyzed using aSEC-MALS to deduce their component protein species. The analysis was performed on an Agilent 1200 high-performance liquid chromatography (HPLC) system. Samples were injected onto a Superdex™ 200 10/300 GL column (GE Healthcare Life Sciences) at 1.0 mL/min using 1×PBS, pH 7.4 as the mobile phase at 4° C. for 25 minutes with UV detection wavelength at 280 nM. MALS was performed on a miniDAWN® TREOS® with an Optilab® T-rEX Refractive Index Detector (Wyatt Technology, Santa Barbara, Cali.). Analysis was performed using Agilent OpenLab Chromatography Data System (CDS) ChemStation Edition AIC version C.01.07 and ASTRA version 6.1.7.15. Chromatograms depicting aSEC separation profiles for peaks A and B are depicted in FIG. 32B along with MW of component species as determined by MALS. The profiles show that peak B comprises a dominant species of ~92 kD which is consistent with the calculated molecular weight of XENP25880 (based on amino acid sequence) of 89.8 kDa.

The peaks from purification part 2 were also analyzed using analytical CIEX to further assess the purity and homogeneity of peaks A and B. The analysis was performed on an Agilent 1200 high-performance liquid chromatography (HPLC) system. Samples were injected onto a Proteomix SCX-NP5 5 µM non-porous column (Sepax Technologies, Inc., Newark, Del.) at 1.0 mL/min using 0-40% NaCl gradient in 20 mM MES, pH 6.0 buffer with UV detection wavelength at 280 nM. Analysis was performed using Agilent OpenLAB CDS ChemStation Edition AIC version C.01.07. Chromatogram depicting aCIEX separation of peaks A and B are depicted in FIG. 32C. Notably, the aCIEX separation show that in the peak B material, there are charge variants in addition to a dominant peak. This will be addressed later in Example 3D.

1C: Biological Activity of IL-10 Fusions Proteins

Next, we investigated whether prototype IL-10 fusion proteins in each of the categories described above were biologically active. Following cytokine binding to their receptors, Janus kinases (JAKs) associated with the cytokine receptors phosphorylate STAT proteins which then translocate into the nucleus to regulate further downstream processes. In particular, IL-10 binds to the IL-10 receptor complex and activates JAK1 and Tyk2 which phosphorylate STAT3. Accordingly, we used STAT3 phosphorylation as an indicator of biological activity of prototype IL-10 fusion proteins in the IL10-Fc format (XENP24628), scIL10-Fc format (XENP25880), IL10M1-Fc format (XENP25236), and splitIL10-Fc format (XENP25242).

Human PBMCs were stimulated using 100 ng/ml anti-CD3 antibody (OKT3; plate-bound) for 2 days to induce expression of IL-10 receptors. Following stimulation, T cells were harvested and treated with the IL-10 fusions for 15 minutes. Following treatment, PBMCs were stained with anti-CD4-BV605 (RPA-T4) and anti-CD8-Alexa700 (SK1) antibodies for 30-45 minutes at room temperature. Cells were washed and incubated with pre-chilled (−20° C.) 90% methanol for 20-60 minutes. After incubation with methanol, cells were washed again and stained with anti-CD45RA-PE (HI100), anti-CD25-BV421 (M-A251), anti-FoxP3-Alexa488 (259D), and anti-pSTAT3-Alexa647 (pY705) to mark various populations and STAT3 phosphorylation. PBMCs were analyzed by flow cytometry, and data depicting STAT3 phosphorylation on various lymphocyte populations are depicted in FIG. 33. Notably, the data show that prototype IL-10 fusion in the scIL10-Fc format (XENP25880) induced STAT3 phosphorylation on various lymphocyte populations (albeit less potently than recombinant IL-10), while IL-10 fusions in the IL10-Fc, IL10M1-Fc, and splitIL10-Fc formats showed only baseline levels of STAT3 phosphorylation.

1D: Alternative C-Terminal Fc Fusion Format

Next, we investigated whether the geometry and positioning of IL-10 in the fusion proteins of the invention impacted their activity. Accordingly, we generated IL-10 fusion proteins with IL-10 molecule(s) covalently attached to the C-terminus of the Fc region.

One such format of the scIL10-Fc fusion category we engineered as a prototype is the heteroFc-scIL10 format (cartoon schematic depicted in FIG. 20B) which comprises a first monomer comprising a scIL-10 covalently attached to the N-terminus of a first heterodimeric Fc chain and a second monomer comprising a complementary second heterodimeric Fc chain that is "Fc-only" or "empty-Fc". An illustrative protein of the heteroFc-scIL10 format is XENP28741, sequences for which are depicted in FIG. 22.

Here, we compare the induction of STAT3 phosphorylation by XENP28741 and XENP25981 (a corresponding scIL10-heteroFc fusion as a comparator; sequences for which are depicted in FIG. 21). XENP28741 and XENP25981 were produced and purified as generally described in Example 1B.

Fresh PBMCs were treated with the IL-10 fusions for 15 minutes. Following treatment, PBMCs were stained with anti-CD3-BUV395 (UCHT1), anti-CD4-BV605 (RPA-T4), anti-CD8-Alexa700 (SK1), and anti-CD14-BV510 (M5E2) antibodies for 30-45 minutes at room temperature. Cells were washed and incubated with pre-chilled (−20° C.) 90% methanol for 20-60 minutes. After incubation with methanol, cells were washed again and stained with anti-CD45RA-PE (HI100), anti-CD25-BV421 (M-A251), anti-FoxP3-Alexa488 (259D), and anti-pSTAT3-Alexa647 (pY705) to mark various populations and STAT3 phosphorylation. PBMCs were analyzed by flow cytometry, and data depicting STAT3 phosphorylation on various lymphocyte populations are depicted in FIG. 34. The data show that C-terminal Fc fusion XENP28741 demonstrates greater potency in induction of STAT3 phosphorylation than N-terminal Fc fusion XENP25981 indicating that position of IL-10 in the fusion proteins of the invention does impact on their biological activity.

Example 2: Attenuating the Potency of IL-10 Fusion Proteins

We reasoned that decreasing the affinity of IL-10 fusion proteins for IL10R1 (and by extension, decreasing their potency) would decrease antigen sink and extend the half-life of the IL-10 fusion proteins. Towards this, we designed IL-10 variants with the aim to reduce affinity and potency of the IL-10 fusion proteins of the invention and investigated them in the context of scIL10-Fc fusions.

2A: Engineering IL-10 Variants for Reduced Affinity and Potency

Using the crystal structure of human IL-10 complexed with IL-10R1 as reported by Josephson et al. (2001) [PDB code 1J7V] and modeling in Molecular Operating Environment (MOE; Chemical Computing Group, Montreal, Quebec, Canada) software, we identified the following as IL-10 residues in contact with IL-10R1: N21, D28, Q38, D41, D44, Q42, N45, E142, D144, and E151 (numbered according to human IL-10 mature form sequence, as depicted in FIG. 1).

Based on the above, we designed a number of IL-10 variants with isosteric substitutions (reasoning that isosteric substitutions have less potential for immunogenicity) at the contact residues with the aim to reduce the potency of biologically functional IL-10. Illustrative substitutions include N21D, D28N, Q38E, D41N, Q42E, D44N, N45D, E142Q, D144N, and E151Q. In addition, it has been previously reported by Yoon et al. (2012) that viral IL-10 (an IL-10 homolog encoded by Epstein-Barr virus; sequence for which is depicted in FIG. 4) had a much weaker affinity for IL-10R1 in comparison to human IL-10. We investigated substitutions described by Yoon et al. at M39, L43, and I87 for their corresponding viral IL-10 residues (i.e. M39T, L43V, and I87A) as controls. It is envisioned that the substitutions described here can be used alone or in combination in the context of IL-10 monomer, IL-10 domains (e.g. hIL-10(A-D) and hIL-10(E-F)), IL10M1, or scIL-10. Sequences for illustrative IL-10 monomer variants comprising substitutions as described above are depicted in FIG. 35. It should be noted that the substitution numberings for IL-10 monomer are based on the mature form IL-10 sequence.

2B: Affinity of Variant IL-10 for IL-10 Receptor

To investigate the effect of substitutions described in Example 2A on the affinity of IL-10 for IL10R1, we first engineered the substitutions in the context of IL-10M1. Sequences for illustrative IL10M1 variants are depicted in FIG. 36. It should be noted that the substitution numberings for IL-10M1 variants are based on the mature form IL-10 sequence.

Illustrative (IL10M1)$_1$-heteroFc fusions proteins comprising selected IL10M1 variants (sequences for which are depicted in FIG. 40) were produced and purified as generally described in Example 1B. Next, we investigated the affinity of the variant IL-10 fusions for human IL10R1 using Octet, a BioLayer Interferometry (BLI)-based method. Experimental steps for Octet generally including the following: Immobilization (capture of ligand to a biosensor); Association (dipping of ligand-coated biosensors into wells containing serial dilutions of the analyte); and Dissociation (returning of biosensors to well containing buffer) in order to determine the affinity of the test articles. A reference well containing buffer alone was also included in the method for background correction during data processing. In particular, AR2G biosensor was used to capture IL10R1-Fc and dipped into multiple concentrations of each IL10M1-Fc test article. Kinetic analyses were performed by global fitting of binding data with a 1:1 Langmuir binding model. The resulting dissociation constant ($K_D$), association rate ($k_a$), and dissociation rate ($k_d$) are depicted in FIG. 38. As some of the sensorgrams were biphasic (as noted in the Figure), the dissociation constant as depicted does not appropriately reflect the effect of affinity engineering on some of the variants; accordingly, the maximum response is also depicted. Taken together, the dissociation constant and/or response show that we engineered IL-10 variants with a range of affinities for IL-10R1.

2C: In Vitro Potency of Variant IL-10 in a STAT3 Phosphorylation Assay

Next, we engineered substitutions identified in Example 2A in the context of single-chain IL-10 complex. Sequences for illustrative scIL-10 variants are depicted in FIG. 39. It should also be noted that for scIL10 variants, substitutions in monomer 1 and monomer 2 do not have to be identical. For example, for scIL10 variant designated huIL10.65, the first monomer comprises a N45D variant, but does not comprise a corresponding N45D variant in the second monomer (i.e. does not comprise N205D).

Illustrative scIL10-heteroFc and heteroFc-scIL10 fusion proteins comprising selected scIL-10 variants (sequences for which are respectively depicted in FIGS. 40-41) were produced and purified as generally described in Example 1B. Next, we investigated the in vitro activity of the variant IL-10 fusions in a STAT3 phosphorylation assay as described in Example 1D. The data depicted in FIG. 42 show that the engineered IL-10 as described above provided for IL-10 fusions with a wide range of potencies in inducing STAT3 phosphorylation suggesting that the substitutions identified in Example 2A are suitable for modulating the affinity and potency of IL-10 in various contexts (i.e. both in various IL-10 configurations as well as various IL-10 fusion formats).

2D: Induction of IFNγ by IL-10 Fusion Proteins

As described above, IL-10 can be either immunostimulatory or immunoinhibitory depending on context. Consistent with an immunostimulatory role, IL-10 has been reported to potentiate cancer immunity through induction of IFNγ-mediated T cell cytotoxicity (Mumm et al. (2013)). Chan et al. (2015) reported that IL-10, in particular, potentiates IFNγ secretion by $CD8^+$ T cells, while suppressing IFNγ in bulk PBMC culture. Additionally, Chan et al. note that IL-10 does not directly induce IFNγ secretion, but rather primes $CD8^+$ T cell for IFNγ secretion upon the appropriate stimulus (e.g. ligation of TCR). Accordingly, we investigated the IFNγ secretion by isolated $CD8^+$ T cells primed with the above-described IL-10 fusion proteins and triggered by an agonistic anti-CD3 antibody. In addition, we investigated expression of CD25 (a T cell activation marker as in known in the art) on $CD8^+$ T cells and percentage of $CD8^+$ T cells expressing Ki67 (a protein strictly associated with cell proliferation as is known in the art).

For these studies, we used $CD8^+$ T cells purified from PBMC using EasySep™ Human $CD8^+$ T Cell Enrichment Kit (STEMCELL Technologies, Vancouver, Canada). $CD8^+$ T cells were first incubated for 3 days with 10 μg/mL of immobilized anti-CD3 antibody (OKT3) and 2 μg/mL of immobilized anti-CD28 antibody (28.2) to induce IL-10 receptor expression on the $CD8^+$ T cells. $CD8^+$ T cells were then primed for 3 days with the indicated test articles followed by 4-5 hours stimulation by 1 μg/mL soluble anti-CD3 antibody. Supernatant was harvested and assessed for IFNγ secretion by the $CD8^+$ T cells using Human IFN-γ Tissue Culture Kit (Meso Scale Discovery, Rockville, Md.). Cells were then stained with anti-CD8-PE (RPA-T8) and anti-CD25-BV421 (M-A251) on ice for 45-60 minutes. Cells were washed and stained with anti-Ki67-APC using eBioscience™ Foxp3/Transcription Factor Staining Buffer Set (ThermoFisher Scientific) and assessed by flow cytometry.

The data as depicted in FIGS. 43-44 show that the IL-10 fusion proteins do potentiate IFNγ secretion by $CD8^+$ T cells, activate $CD8^+$ T cells (as indicated by CD25 expression), and induces proliferation of $CD8^+$ T cells (as indicated by percentage cells expressing Ki67). Consistent with Examples 2B-2C showing a range of binding affinities and potencies in induction of STAT3 phosphorylation, fusions with affinity-engineered scIL-10 variants demonstrated a range of potencies in potentiation of IFNγ secretion, proliferation, and activation of $CD8^+$ T cells. Notably, as depicted in FIGS. 45A-C, the EC50 for induction of STAT3 phosphorylation by the test articles correlated well with the EC50 for potentiation of IFNγ secretion, activation of $CD8^+$ T cells, and induction of $CD8^+$ T cell proliferation.

Example 3: Engineering the scIL10-Fc Format to Optimize Production

Here we describe engineering efforts to improve production of IL-10 fusions in the scIL10-Fc format.

3A: Swapping the scIL-10 from One Fc Chain to the Other

As depicted in FIG. 32A, the separation between peaks A and B were suboptimal. We reasoned that this was due to the isoelectric points of each species (heterodimer vs. homodimer) and that swapping the scIL-10 complex from one arm of the heterodimeric Fc region (having a higher pI) to the other arm of the heterodimeric Fc region (having a lower pI) would provide for a greater difference in isoelectric points between the heterodimeric scIL10-heteroFc species and the homodimeric $(scIL10)_2$-Fc and empty-Fc species. Accordingly, we investigated the production and purification of XENP25238 (sequences depicted in FIG. 21), an IL-10 fusion in the scIL10-heteroFc fusion having the scIL-10 complex covalently attached to the heterodimeric Fc chain having a lower pI. XENP25238 was produced and purified as generally described in Example 1B. FIG. 46A depicts the chromatogram showing purification part 2 of XENP25238 showing the isolation of two peaks (peak B and peak BC), which were further characterized by aSEC-MALS and aCIEX for identity, purity and homogeneity as generally described in Example 1B(a) and depicted in FIGS. 46B-C. The analysis show that peak B comprises a dominant species of ~88 kD. Notably, as indicated by purification part 2, peak B comprising the scIL10-heteroFc fusion XENP25238 was dominant over peak BC comprising the empty-Fc (pI(+): pI(+)) homodimer. This represents an improvement over XENP25880 wherein purification part 2 (as depicted in FIG. 32A) resulted in a peak A comprising the empty-Fc (pI(−): pI(−)) homodimer that was dominant over peak B comprising the scIL10-heteroFc fusion XENP25880. As with XENP25880, the aCIEX separation show that in the peak B material comprising XENP25238, there are charge variants in addition to a dominant peak.

Experiment assessing STAT3 phosphorylation was performed as described in Example 1C to ascertain the biological activity of XENP25880. Data as depicted in FIG. 47 show that swapping the scIL-10 complex from one chain of a heterodimeric Fc region to the other chain did not have an impact on activity.

3B: Engineering Linkers within the scIL-10 Construct

As another approach to improve the production of scIL10-Fc fusion proteins of the invention, we investigated engineering domain linkers of varying lengths between the first IL-10 monomer and the second IL-10 monomer within the scIL-10 complex. FIG. 48 depicts sequences for illustrative scIL-10 complexes comprising domain linkers, and FIG. 49 depicts sequences for illustrative scIL10-Fc fusion proteins comprising the scIL-10 complexes which were produced and purified as generally described in Example 1B.

Engineering linkers within the scIL-10 complex did not appear to substantially impact on the production of IL-10 fusions in the scIL10-heteroFc format (data not shown); however, activity was also unaffected as depicted in FIG. 50 showing induction of STAT3 phosphorylation by scIL10-heteroFc fusions with varying linker lengths (experiment performed as described in Example 2C).

3C: Improved Yield Conveyed by N45D (and N205D) Substitution

Although the N45D substitution was introduced with the aim to reduce the affinity of IL-10 for the IL-10 receptor, the data depicted in Example 2C show that scIL10-heteroFc XENP25981 containing N45D and N205D exhibited activity similar to WT scIL-10-heteroFc XENP25880. However, we surprisingly found that the N45D substitution improved the yield of the scIL10-heteroFc heterodimer.

FIG. 52 depicts the yield from expression of XENP25880 and XENP25981. The Figure lists total yield (mg/L) depicting yield of Fc-containing proteins as purified by protein A; percentage homodimer and heterodimer (as determined by aCIEX separation of the Protein A purified Fc-containing proteins; illustrative chromatograms depicted in FIG. 51); and homodimer and heterodimer yields (mg/L) as calculated based on total yield and percentage homodimer/heterodimer. While there were some batch-to-batch variations in yield, the data show that production of XENP25981 generally resulted in greater yield of the scIL10-heteroFc fusion over the empty-Fc homodimer.

To investigate whether it was the N45D (and N205D) modification which conveyed the improved heterodimer yield, we engineered the N45D (and N205D) modification into the background of other variants (e.g. XENP25986 and XENP25993, sequences for which are depicted in FIG. 53). As above, the yield from expression of XENP25880, XENP25981, XENP25986, and XENP25993 are depicted in FIG. 54. The data show that engineering the N45D in addition to Q38E (in XENP25986) or Q42E (in XENP25993) enhanced heterodimer expression relative to WT scIL10-heteroFc XENP25880.

3D: Removing Charge Variants

As shown in Examples 1B(a) and 3A, purified samples of molecules in the scIL10-heteroFc format such as XENP25880 and XENP25238 contained charge variants in addition to a dominant peak. We reasoned that this charge heterogeneity resulted from degradation-related post-translational modifications (PTMs) such as deamidation which contributes negative charge. While deamidation is normally slow and takes place following long term stress (e.g. during storage), we hypothesized that engineering the biologically functional IL-10 homodimer as a single-chain IL-10 complex and/or as a Fc fusion perturbed the IL-10 structure so that particular asparagine residues (such as those at the IL-10:IL-10 covalent attachment interface in the scIL-10 complex; or at the IL-10: Fc covalent attachment interface) were more susceptible to deamidation. Accordingly, we engineered IL-10 (and scIL-10) variants comprising substitution of select asparagine residues for alanine or glutamine (which although susceptible to deamidation, is much less so than asparagine).

In particular, it has previously been noted that asparagine preceding small residues such as glycine, serine, or alanine are most susceptible to deamidation (Stephenson et al. (1989)). Accordingly, we engineered modifications at residues N10, N92, N126, and N160 (as well as corresponding residues N170, N252, N286, and N320 in the scIL-10 complex). Illustrative IL-10 monomer variants include one or more of the following substitutions: N10A, N10Q, N92A, N126A, N160A. Illustrative scIL-10 variants include one or more of the following substitutions: N10A, N92A, N126A, N160A, N170A, N170Q, N252A, N286A, N320A, K317_, I318_, R319_, and N320_. Sequences for illustrative IL-10 monomer variants and corresponding scIL-10 variants are depicted respectively in FIGS. 55 and 56. It should be noted that the substitution numberings for IL-10 variants are based on the mature form IL-10 sequence, and the substitution numberings for scIL10 variants are based on the scIL-10 sequences as depicted in FIG. 15. It should also be noted that for scIL-10 variants, the substitutions in monomer 1 and monomer 2 do not have to be identical. For example for scIL10 variant designated as huIL10.90, the first monomer does not comprise a modification at N160, while the second monomer comprises a modification at the corresponding residue (i.e. N320A).

Alternatively, we reasoned that the domain linker (($G_4S$)$_2$ (SEQ ID NO: 32)) between the scIL-10 complex and the Fc chain provides an additional deamidation site (i.e. N-G motif). Accordingly, we engineered XENP28295 and XENP28904 (scIL10-heteroFc fusions without a domain linker) as well as XENP28905 (an additional scIL10-heteroFc fusion without a domain linker and additionally comprising an scIL-10 variant having N10A and N170A substitutions as described above), sequences for which are depicted in FIG. 59.

In addition to deamidation, aspartic acid isomerization could also contribute to heterogeneity. As is known to those skilled in the art, there are particular motifs which cause an aspartic acid residue to be more susceptible to isomerization (see for example, Sydow et al. (2014), herein incorporated by reference). We generated an illustrative IL-10 variant with a substitution of residue D28 for alanine (sequences for IL-10 monomer variant and corresponding scIL-10 variant are depicted in FIGS. 57-58).

The scIL-10 variants were engineered as part of scIL10-heteroFc fusion proteins (sequences for which are depicted in FIG. 59), as well as part of a heteroFc-scIL10 fusion (sequences for which are depicted in FIG. 60), and produced and purified as generally described in Example 1B. Protein A purified samples of XENP28295, XENP28635, and XENP28641 were characterized by aCIEX as generally described in Example 1B(a), chromatograms for which are depicted in FIG. 61. In comparing the chromatogram depicted in FIG. 61A for XENP25981 with the chromatogram depicted in FIG. 61B for XENP28295, we note that the acidic peak disappears for fusions without a N-terminal linker, presumably due to the elimination of N320 deamidation. In comparing the chromatogram depicted in FIG. 61A for XENP25981 with the chromatogram depicted in FIG. 61C for XENP28295 and XENP28641, we note that the acidic peak disappears for fusions with scIL-10 variants comprising N160A and N320A, again presumably due to the elimination of N320 deamidation. Unexpectedly, as shown in FIG. 61D chromatogram for XENP28635, it appears that the N10A substitution (and corresponding N170A substitution) removes the leading acidic peak.

Importantly, the scIL-10 variants engineered to remove potential degradation sites did not impact on the activity of the IL-10 fusions as indicated by induction of STAT3 phosphorylation (experiment performed as described in Example 2B; data depicted in FIG. 62) and potentiation of IFNγ secretion by CD8$^+$ T cell, CD8$^+$ T cell proliferation, and CD8$^+$ T cell activation (experiment performed as generally described in Example 2D; data depicted in FIG. 63).

3E: Removing Potential N-Glycosylation Site

The IL-10 monomer includes a glycosylation motif (N-X-S) at residues 116-118 (according to the human IL-10 mature form sequence). While it has been reported that human IL-10 is not glycosylated at this site (Westerhof et al. (2012)), we designed IL-10 variants (and corresponding scIL-10 variants) with the aim to abrogate potential for errant glycosylation. Accordingly, we engineered modifications at the following residues: N116, K117, S118 (according to the human IL-10 mature form sequence), and corresponding N276, K277, and S278 in the scIL-10 complex. Illustrative IL-10 monomer variants include one or more of the following substitutions: N116D, N116Q, K117P, and S118A. Illustrative scIL-10 variants include one or more of the following substitutions: N116D, N116Q, K117P, S118A, N276D, N276Q, K227P, and S228A. Sequences for illustrative IL-10 monomer variants and scIL-10 variants designed with the aim to remove the potential N-glycosylation site are depicted in FIGS. 63-63. scIL-10 variants were engineered as part of scIL10-heteroFc fusion proteins (sequences for which are depicted in FIG. 66) and produced and purified as generally described in Example 1B.

3F: Removing Disulfide Bridges

The IL-10 monomer comprises two sets of disulfide bridges (formed by C12: C108 and C62: C114) which stabilizes the assembly of helices A-D (Walter et al., 2014). We reasoned that disulfide bridges may needlessly complicate the production of the scIL10-Fc fusion proteins of the invention and, for example, increase heterogeneity. Accordingly, we engineered modifications to remove the disulfide bridge. Sequences for illustrative IL-10 monomer variants (and corresponding scIL-10 variants) with modifications introduced with the aim to abrogate disulfide bridge formation are depicted in FIGS. 67-68. scIL-10 variants were engineered as part of scIL10-heteroFc fusion proteins (sequences for which are depicted in FIG. 69) and produced and purified as generally described in Example 1B.

3G: Removing C-Terminal Lysine or Glycine-Lysine

As another approach towards improving production/purification of the IL-10 fusion proteins of the invention, the IL-10 fusions proteins were engineered with the lysine (K) or glycine-lysine (GK) at the C-terminus of the Fc region removed. Sequences for illustrative IL-10 fusion proteins having the C-terminal K or GK removed are scattered throughout the figures with annotation G446del and/or K447del.

Example 4: Further Engineering the IL10M1-Fc Format

As described in Example 1C, the prototype (IL10M1)$_2$-Fc fusion XENP25236 was biologically inactive in a pSTAT3 assay, despite activity of the IL10M1 molecule alone as described by Josephson et al. (2000). We reasoned that retaining the activity of IL10M1 in the context of fusion to an Fc region requires further engineering of the IL10M1 molecule. Here we describe design of IL10M1 variants with the aim to restore activity of fusions in the IL10M1-Fc category. It should be noted that amino acid numbering in the following subsections of Example 4 are according to human IL-10 mature form sequence (without IL10M1 linker included in the numbering).

4A: Engineering Disulfide Bridges in IL10M1

In one approach, we reasoned that in view of intramolecular domain swapping (i.e. helices A-D and helices E-F within the same IL10M1 molecule) rather than intermolecular domain swapping (i.e. between helices A-D and helices E-F of two separate IL-10 monomers), the disulfide bridges stabilizing helices A-D (Walter et al., 2014) are no longer necessary, and may in fact be detrimental to activity of the IL10M1-Fc fusions, for example, through misfolding. Accordingly, we designed IL10M1 variants comprising modifications at C12, C62, C108, and/or C114 to remove the disulfide bridges. Illustrative IL10M1 variants are depicted in FIG. 68, and illustrative IL10M1-Fc fusions comprising the variants are depicted in FIG. 69.

Alternatively, it may be that in view of intramolecular domain swapping (i.e. helices A-D and helices E-F within the same IL10M1 molecule) rather than intermolecular domain swapping (i.e. between helices A-D and helices E-F of two separate IL-10 monomers), additional stabilization of the interaction between helices A-D and helices E-F are required. Based on the crystal structure of IL10M1 as described by Josephson et al. (2000) (PDB code 1Y6K), we identified the following residues as suitable for substituting with cysteine residues: F37, Q38, D41, L47, L48, S51, D55, F56, A64, M68, and V76 in helices A-D; and S118, A120, V121, K138, A139, M140, S141, E142, and Y153. In particular, we conceived introducing disulfide bridges between the following residue pairs: F37C:M140C, Q38C:S141C, D41C:K138C, L47C:K138C, L48C: E142C, S51C: A120C, D55C: A120C, F56C: Y153C, A64C:S118C, M68C: V121C, and V76C: A139C to promote stabilization of the interaction between helices A-D and helices E-F. Illustrative IL10M1 variants with engineered disulfide bridges are depicted in FIG. 70, and illustrative IL10M1-Fc fusions comprising the variants are depicted in FIG. 71.

4B: Stability Variants

In line with the idea above to stabilize the IL10M1 molecule, we used modeling in MOE software to identify single substitutions in core residues which may contribute to increased stability. Core residues we identified to be suitable for substitutions include: L19, L23, L26, A29, F30, V33, F37, L47, L48, L52, F56, A64, L65, S66, M68, I69, F71, Y72, V76, M77, A80, E81, I87, V91, L94, G95, L98, L101, L105, L112, S118, V121, V124, F128, K138, A139, M140, S141, F143, F146, I147, and I150. Using the Residue Scanning module in MOE software, we performed in silico single point mutations at the above identified residue to predict their effect on stability of IL10M1 and its affinity for IL10R1, data for which are shown in FIG. 72A-AQ.

In addition, we used Rosetta software suite (RosettaCommons) for further stability modeling. The IL-10 dimer structure was prepared according to Rosetta's relax protocols. Next, we ran a number of fixed backbone optimization protocols of 100 trajectories each to explore the effect of allowing hydrophobic residues versus all amino acid residues either as independent mutations or in combination both in the context of single starting structure as well as in an ensemble of structures. We also used a flexible backbone approach that iterates between design and backbone movement. We used only sites in the core of each chain as identified above.

For illustrative purposes, we designed IL10M1 variants and produced IL10M1, and corresponding IL10M1-Fc fusions, with mutations (i.e. L47Q, S118A, and A139Q) which were consistently predicted to improve stability between the different approaches described above, sequences for which are depicted respectively in FIGS. 73-74.

4C: Engineering Alternative Linkers for IL10M1

Next, we designed IL10M1 variants with different linkers. In one approach, we aimed to increase the rigidity of the linker by introducing proline residues, removing serine residues, or shortening the linker length. Sequences for illustrative IL10M1 variants designed with this approach in mind are depicted in FIG. 75. Alternatively, we aimed to increase the flexibility of the linker, for example, by extending the linker length. Sequence for an illustrative IL10M1 variant designed with this approach in mind are also depicted in FIG. 75. Sequences for IL10M1-Fc fusions with these illustrative IL10M1 variants are depicted in FIG. 76.

Example 5: IL-10 Fusions Having IL-10 Variants with 109H-Based Sequence

A majority of the IL-10 fusions described above, and their component IL-10 variants, were generated in the context of the IL-10(109L) sequence. We engineered illustrative IL-10 variants in the context of the IL-10(109H) sequence (sequences for which are depicted in FIG. 77). Next, we engineered IL-10 fusions in the scIL10-heteroFc and the heteroFc-scIL10 formats with the IL-10(109H) variants, sequences for which are depicted in FIGS. 78 and 79, to determine whether the different IL-10 sequence contexts impact the activity of the IL-10 fusions. These IL-10 fusions were produced as generally described in Example 1B.

Activity of the IL-10 fusions having IL-10(109H) variants were determined in a pSTAT3 assay as generally described above, data for which are depicted in FIG. 80-85. The data show that the IL-10 fusions based on the IL-10(109H) maintained a range of potency on the various cell types. Surprisingly, the data show that each of the IL-10 fusions based on the IL-10(109H) sequence demonstrated less efficacy (i.e. maximum induction of STAT3 phosphorylation) on each of the cell types investigated in comparison to corresponding IL-10 fusions (e.g. same variants) based on the IL-10(109L) sequence. This indicates that the particular residue at position 109 of IL-10 may be important for modulating the activity of IL-10 fusions.

Example 6: Further Engineering of IL-10 Fusion Proteins to Increase Half-Life

To further increase the half-life, the IL-10 fusion proteins of the invention were further engineered with Xtend Fc (M428L/N434S substitutions). Sequences for illustrative IL-10 fusion proteins with Xtend are depicted in FIG. 86.

Example 7: Engineering Targeted IL-10 Fusion Proteins

As described above, we envisioned the selectively targeting IL-10 to TILs expressing checkpoint receptors such as PD-1, or selectively targeting IL-10 to CD8$^+$ T cells. Accordingly, we envisioned a number of targeted IL-10 formats, cartoon schematics for which are depicted in FIGS. 87-90.

FIG. 87 depicts illustrative formats for targeted IL-10 fusions based on the IL10-Fc category, herein referred to as the "targeted IL10-Fc" category.

FIG. 88 depicts illustrative formats for targeted IL-10 fusions based on the scIL10-Fc category, herein referred to as the "targeted scIL10-Fc" category. One such format of this category we engineered is the "anti-Xx×scIL10-heteroFc" format which comprises a first monomer comprising an antigen-binding domain covalently linked to the N-terminus of a first heterodimeric Fc chain and a second monomer comprising a scIL-10 covalently attached to the N-terminus of a second heterodimeric Fc chain (optionally via a domain linker).

FIG. 89 depicts illustrative formats for targeted IL-10 fusions based on the IL10M1-Fc category, herein referred to as the "targeted IL10M1-Fc" category. One such format of this category we engineered is the "anti-Xx×(IL10M1)$_1$-heteroFc" format which comprises a first monomer comprising an antigen-binding domain covalently linked to the N-terminus of a first heterodimeric Fc chain and a second monomer comprising an IL10M1 covalently attached to the N-terminus of a second heterodimeric Fc chain (optionally via a domain linker). Another such format of this category we engineered is the "mAb-(IL10M1)$_2$" which comprises two identical monomers, each monomer comprising an antigen-binding domain covalently linked to the N-terminus of a homodimeric Fc chain which is covalently linked via the C-terminus, optionally via a linker, to an IL10M1.

FIG. 90 depicts illustrative formats for targeted IL-10 fusions based on the splitIL10-Fc category, herein referred to as the "targeted splitIL10-Fc" category.

Example 8: CD8-Targeted IL-10 Fusion Proteins

As described above, IL-10 potentiates cancer immunity primarily through CD8$^+$ T cells. In fact as described by Chan et al. (2015), incubation of IL-10 with bulk PBMCs leads to suppression of IFNγ secretion, suggesting that the immunosuppressive effect of IL-10 is potentiated through non-CD8$^+$ cell types. In addition, a high CD8/CD4 T cell ratio in TILs is generally considered a good prognostic marker for tumor therapy. Accordingly, we reasoned it would be useful to engineer CD8-targeted IL-10 fusion proteins to enhance the immunostimulatory potential of IL-10 by selectively targeting CD8$^+$ T cells.

8A: Production of Prototype CD8-Targeted IL-10 Fusion Proteins

Illustrative anti-CD8 and anti-NKG2D variable regions that find use in the CD8-targeted IL-10 fusion proteins of the invention are depicted in FIGS. 92 and 93.

Plasmids coding for IL-10 components or the anti-CD8 or anti-NKG2D variable regions were constructed by standard gene synthesis, followed by subcloning into a pTT5 expression vector containing fusion partners (e.g., backbones and/or CH1/partial hinge as depicted in FIGS. 10, 11, and/or 12). Proteins were produced by transient transfection in HEK293E cells and were purified by a two-step purification process comprising protein A chromatography (GE Healthcare) and ion exchange chromatography.

Sequences for illustrative CD8-targeted IL-10 fusions in the "anti-Xx×(IL10M1)$_1$-heteroFc" are depicted in FIG. 94. Sequences for illustrative CD8-targeted IL-10 fusions in the "mAb-(IL10M1)$_2$" format are depicted in FIG. 95. Sequences for illustrative CD8-targeted and NKG2D-targeted IL-10 fusions in the "anti-Xx×scIL10-heteroFc" format are depicted respectively in FIGS. 96 and 98. Sequences for illustrative CD8-targeted IL-fusions in the "anti-Xx×scIL10-heteroFc" format comprising IL-10 variants are depicted in FIG. 97.

8B: Biological Activity of CD8-Targeted IL-10 Fusion Proteins

We investigated induction of STAT3 phosphorylation by the prototype CD8-targeted IL-10 fusions on various lymphocyte populations in an experiment performed as generally described in Example 1D, data for which are depicted in FIG. 99. The data show that the CD8-targeted IL-10 fusion XENP25794 induced STAT3 phosphorylation on CD8$^+$ T cells much more potently than the non-targeted IL-10 fusion (XENP25880). Notably for the test article concentration range investigated, it appears that the CD8- targeted IL-10 fusion induced STAT3 phosphorylation on CD4+ T cells less potently than XENP25880. In addition, the NKG2D-targeted IL-10 fusion (XENP25952) also showed a selectivity for CD8+ T cells over CD4+ T cells indicating that additional targets other than CD8 may be used to target IL-10 fusion proteins to CD8+ T cells.

Example 9: PD-1-Targeted IL-10 Fusion Proteins

As described above, immune checkpoint proteins such as PD-1 are up-regulated in tumor-infiltrating lymphocytes. Accordingly, PD-1-targeted IL-10 fusion proteins were conceived to selectively target T cells in the tumor environment.

9A: Production of Prototype PD-1-Targeted IL-10 Fusion Proteins

Illustrative anti-PD-1 variable regions that find use in the PD-1-targeted IL-10 fusion proteins of the invention are depicted in FIG. 100.

Plasmids coding for IL-10 components or the anti-PD-1 variable regions were constructed by standard gene synthesis, followed by subcloning into a pTT5 expression vector containing fusion partners (e.g., backbones and/or CH1/partial hinge as depicted in FIGS. 10, 11, and/or 12). Proteins were produced by transient transfection in HEK293E cells and were purified by a two-step purification process comprising protein A chromatography (GE Healthcare) and ion exchange chromatography.

Sequences for illustrative PD-1-targeted IL-10 fusions in the "anti-X×scIL10-heteroFc" format are depicted in FIG. 101. Further, sequences for illustrative PD-1-targeted IL-10 fusions in the "anti-X×scIL10-heteroFc" format comprising IL-10 variants are depicted in FIG. 102. Sequences for PD-1-targeted IL-10 fusion proteins in the "anti-X×heteroFc-scIL10" format are depicted in FIG. 103.

9B: Non-Competing PD-1 Binding Domain

Additionally, as it would be useful to combine the targeted IL-10 fusion proteins of the invention with PD-1 blockade antibodies, or to administer targeted IL-10 fusion proteins of the invention subsequent to treatment with PD-1 blockade antibodies, it is important that the PD-1 targeting arm of the targeted IL-10 fusion protein does not bind the same or similar epitope as the PD-1 blockade antibody. PD-1 blockade antibodies contemplated herein include, but are not limited to, nivolumab and pembrolizumab.

Illustrative non-competing anti-PD-1 binding domains contemplated for use in the PD-1-targeted IL-10 fusion proteins of the invention are referred to as mAb A, mAb B, and mAb C (sequences for their humanized variable regions are depicted in FIG. 104, humanized using string content optimization (see, e.g., U.S. Pat. No. 7,657,380, issued Feb. 2, 2010)).

Tandem epitope binning was performed to demonstrate that the mAbs did not compete with nivolumab and pembrolizumab. Epitope binning was performed using the Octet HTX instrument. AMC (anti-mouse Fc) biosensors were first used to capture murine-Fc fusions of human PD-1, dipping into 100 nM of a first antibody (indicated on the left side of FIG. 105) and then dipped into 100 nM of a second antibody (indicated on the top of FIG. 105). BLI-responses were normalized against the BLI-response of dipping the biosensor into HBS-EP buffer followed by dipping into the anti-PD-1 antibody. If the antibody pair provided a normalized BLI-response less than 0.5, the pair was considered competing or partially competing and to be in the same epitope bin, i.e., recognizing very similar, or largely overlapping, epitopes. If the antibody pair provided a normalized BLI-response greater than 0.5, the pair was considered non-competing and to bin to different epitopes. Antibodies tested were a bivalent anti-PD-1 mAb based on nivolumab, in-house produced pembrolizumab, chimeric mAb A, chimeric mAb B, and chimeric mAb C. PD-L1-Fc was also included to investigate the blocking of PD-1:PD-L1 interaction by the antibodies. The binning shows that anti-PD-1 mAb A, mAb B, and mAb C do not compete with nivolumab or pembrolizumab. Additionally, mAb A does not appear to block the PD-1:PD-L1 interaction, while mAb B and mAb C are partial blockers of the PD-1:PD-L1 interaction. Sequences for illustrative PD-1-targeted IL-10 fusions utilizing a PD-1-targeting arm based on humanized mAb C are depicted in FIG. 106.

9C: Biological Activity of PD-1-Targeted IL-10 Fusion Proteins

We investigated induction of STAT3 phosphorylation by the prototype PD1-targeted IL-10 fusion on various lymphocyte populations in an experiment performed as generally described in Example 1C, data for which are depicted in FIG. 107. Note that for this experiment, PBMC was first activated using 100 ng/ml anti-CD3 antibody (OKT3; plate-bound) for 2 days to induce expression of PD-1 and mimic the tumor environment. The data show that the PD1-targeted IL-10 fusion induced STAT3 phosphorylation on the various T cell populations much more potently than the non-targeted IL-10 fusion (XENP25880).

We also investigated the potentiation of IFNγ secretion and proliferation of CD8+ T cell populations by prototype PD-1-targeted IL-10 fusions. For these studies, we used CD8+ T cells purified from PBMC using EasySep™ Human CD8+ T Cell Enrichment Kit (STEMCELL Technologies, Vancouver, Canada). CD8+ T cells were first incubated for 3 days with 10 µg/mL of immobilized anti-CD3 antibody (OKT3) and 2 µg/mL of immobilized anti-CD28 antibody (28.2) to induce IL-10 receptor expression on the CD8+ T cells. CD8+ T cells were then primed for 3 days with the indicated test articles followed by 6 hours stimulation by 1 µg/mL soluble anti-CD3 antibody. Supernatant was harvested and assessed for IFNγ secretion by the CD8+ T cells using Human IFN-γ Tissue Culture Kit (Meso Scale Discovery, Rockville, Md.). Cells were then stained with anti-CD8-PE (RPA-T8) and anti-CD25-BV421 (M-A251) on ice for 45-60 minutes. Cells were washed and stained with anti-Ki67-APC using eBioscience™ Foxp3/Transcription Factor Staining Buffer Set (ThermoFisher Scientific) and assessed by flow cytometry. Data showing IFNγ secretion by the CD8+ T cells, CD8+ T cell proliferation, and CD8+ T cell activation are depicted in FIG. 108.

9D: PD-1-Targeting Restores Potency of Reduced Potency IL-10-Fc Fusions on Induction of CD8+ T Cell Proliferation Next, the impact of PD-1-targeting on reduced potency IL-10-Fc fusions was investigated. CD8+ T cells were first incubated for 3 days with 10 µg/mL of immobilized anti-CD3 antibody (OKT3) and 2 µg/mL of immobilized anti-CD28 antibody (28.2) to induce IL-10 receptor expression on the CD8+ T cells. CD8+ T cells were then primed for 3 days with the indicated test articles followed by 6 hours stimulation by 1 µg/mL soluble anti-CD3 antibody. Cells were then stained with staining antibodies including anti-CD8-BV421 (SK1) on ice for 45-60 minutes. Next, cells were washed and stained with anti-Ki67-APC using eBioscience™ Foxp3/Transcription Factor Staining Buffer Set (ThermoFisher Scientific) and assessed by flow cytometry. Test articles investigated were XENP30007 (scIL10.104-Fc), XENP30008 (scIL10.105-Fc), XENP30010 (scIL10.107-Fc), XENP30520 (αPD-1(mAb C_H1_L1.1)× huIL10.104)), XENP30521 (αPD-1(mAb C_H1_L1.1)× huIL10.105)), and XENP30522 (αPD-1(mAb C_H1_L1.1)× huIL10.107)).

Data showing proliferation of CD8+ T cells as indicated by percentage of CD8+ T cells that were Ki67+ are depicted in FIG. 109. For each of the reduced potency IL-10-Fc fusions, potency on induction of CD8+ T cell proliferation was restored by PD-1-targeting. It is presumed that the CD8+ T cells targeted for proliferation are PD-1-expressing CD8+ T cells similar to those that would be found in the tumor environment.

9E: Further Tuning the Potency of PD-1-Targeted IL-10-Fc Fusions

Next, the impact of different PD-1-targeting arms as well as format of the PD-1-targeted IL-10-Fc fusions was investigated in a STAT3 phosphorylation assay as generally described above. Test articles investigated utilized a PD-1-targeting arm based on mAb C_H1_L1.1, a PD-1-targeting arm based on 1C11, or a RSV-targeting arm based on Numax/motavizumab; a weaker IL-10 variant (IL10.105) or a stronger IL-10 variant (IL10.102); as well as N-terminal scIL-10 vs C-terminal scIL-10.

Data showing phosphorylation of STAT3 are depicted in FIG. 110. In each case, the PD-1-targeted IL-10-Fc fusions were more potent than the corresponding RSV-targeted IL-10-Fc fusion. In most but not all instances, the PD-1-targeting arm based on 1C11 enhanced potency to a greater extent than the PD-1-targeting arm based on mAb C_H1_L1.1. Notably, for the weaker potency IL-10-Fc fusion (having IL10.105), C-terminal attachment of the scIL-10 resulted in lower potency irrespective of the particular targeting arm; while for the stronger potency IL-10-Fc fusion (having IL10.102), C-terminal attachment of the scIL-10 resulted in greater potency irrespective of the particular targeting arm.

Example 10: TIGIT-Targeted IL-10 Fusions Proteins

As described above, immune checkpoint proteins such as TIGIT are up-regulated in tumor-infiltrating lymphocytes. Accordingly, TIGIT-targeted IL-10 fusion proteins were conceived to selectively target T cells in the tumor environment.

10A: Generating TIGIT Binding Domain

Recombinant human TIGIT and cynomolgus TIGIT (sequences depicted in FIG. 111) were used for phage panning. In-house de novo phage libraries were built displaying Fab and scFv variants (respectively referred to hereon as "Fab library" and "scFv library") on phage coat protein pIII. Both the Fab library and the scFv library were panned in five rounds as follows: 1) human TIGIT, 2) cynomolgus TIGIT, 3) human TIGIT, 4) cynomolgus TIGIT, and 5) human TIGIT with increasing levels of stringency (both in terms of antigen concentration as well as wash stringency). after each round, eluted phage were added to log-phase XL1-Blue cells (Agilent, Wilmington, Del.) and amplified overnight at 37° C., 250 rpm.

192 clones were sequenced from each of the panning rounds 3, 4, and 5 from both the Fab library and the scFv library resulting in 1,152 clones. We investigated cell-surface binding of these clones on TIGIT-transfected Jurkat cells (hereon, Jurkat-TIGIT). 100K Jurkat-TIGIT cells were used per well on a 384-well plate, incubated with phage supernatant or control anti-TIGIT-APC (Biolegend, San Diego, Calif.) for 1 hour at 4° C. and washed. Cells were then stained with secondary antibodies and analyzed for phage binding by iQue Screener (Intellicyt, Albuquerque, N. Mex.). FIGS. 115-116 depict an illustrative plate readout and associated histogram (380 clones+4 controls) with controls (control anti-TIGIT mAb, parental K07 phage+staining antibodies, staining antibodies only, and cell only), and our favorite clone (i.e. 2A5B4; sequences for which are depicted in FIG. 112 as a bivalent mAb) highlighted. Based on analysis of both MFI and histograms indicating binding of phage clones to Jurkat-TIGIT cells, 92 unique clones were selected out of 1,152 clones.

Plasmids containing the variable heavy and variable light domains of the 92 clones were constructed by Gibson assembly and subcloned into a pTT5 expression vector containing the coding sequence for the IgG1 constant regions (with E233P/L234V/L235A/G236del/S67K ablation variants). DNA was transfected in HEK293E for expression and resulting bivalent mAbs were purified from the supernatant using protein A chromatography.

Next, we investigated the binding of the 92 bivalent mAbs to Jurkat-TIGIT. Jurkat-TIGIT cells were incubated with indicated concentrations of XENP27507 and phage-derived anti-TIGIT mAbs, as well as control antibody XENP19351 (a bivalent anti-TIGIT mAbs based on 10A7 as described in WO 2015/009856 with E233P/L234V/L235A/G236del/S67K ablation variants; sequences for which are depicted in FIG. 113) for 1 hour at 4° C. Cells were then stained with Alexa Fluor® 647 AffiniPure F(ab')₂ Fragment Goat Anti-Human IgG, Fcγ fragment specific secondary antibody (Jackson ImmunoResearch, West Grove, Penn.) for 1 hour at 4° C. and analyzed by flow cytometry. Data illustrating binding for XENP27507 and 5 additional phage-derived mAbs are depicted in FIG. 117, and show that each of the phage-derived mAbs were able to bind to Jurkat-TIGIT cells.

Finally, we performed an affinity screen of the 92 bivalent mAbs to TIGIT using Octet, a BioLayer Interferometry (BLI)-based method. Experimental steps for Octet generally includes the following: Immobilization (capture of ligand to a biosensor); Association (dipping of ligand-coated biosensors into wells containing the analyte); and Dissociation (returning of biosensors to well containing buffer) in order to determine the affinity of test articles. A reference well containing buffer alone was also included in the method for background correction during data processing. In particular, HIS1K biosensors were used to capture His-tagged human TIGIT or His-tagged cynomolgus TIGIT and dipped into 100 nM of each bivalent mAb. Kinetic analyses were performed by global fitting of binding data with a 1:1 Langmuir binding model. The resulting apparent dissociation constant ($K_{Dapp}$), association rate ($k_a$), and dissociation rate ($k_d$) are depicted in FIG. 118 for XENP27507, selected 5 phage-derived mAbs, and control mAb XENP19351. The clones were ranked based on $K_{Dapp}$ ($K_D$ apparent, due to avidity concerns) values for human and cynomolgus TIGIT. The data show that each of the phage-derived mAbs bound to both human and cynomolgus TIGIT with a range of apparent $K_D$.

Based on the above experiments investigating cell-surface TIGIT binding and $K_{Dapp}$, we identified ~20 suitable TIGIT ABD (out of 1,152 initial sequences) with a good balance of cell-surface antigen binding and affinity.

10A(a): Characterization of TIGIT Blockade

Blockade of checkpoint receptor/ligand interaction is necessary for inhibition of T cell anergy. Accordingly, it may be useful for the TIGIT-targeting arm of the targeted IL-10 fusion proteins to be capable of blocking the binding of CD112 and PVR to TIGIT.

In a first experiment, we performed tandem epitope binning using Octet to investigate whether the phage-derived mAbs bound the same epitope as XENP19351 (a confirmed blocker of TIGIT ligand) or XENP19352 (a confirmed non-blocker of TIGIT ligand; sequences for which are depicted in FIG. 114), with the reasoning that phage-derived mAbs which binned to the same epitope as XENP19351 are blockers of TIGIT/TIGIT ligand interactions. HIS1K biosensors were first dipped into XENP23423 followed by dipping into 100 nM of XENP19351 or XENP19352 and then dipping into 100 nM of the indicated test articles. BLI-responses were normalized against the BLI-response of dipping the biosensor into HBS-EP buffer followed by dipping into the antibodies. If the antibody pair provided a BLI-response less than 0.5, the pair was considered competing and to be in the same epitope bin, i.e., recognizing very similar, or largely overlapping, epitopes. If the antibody pair provided a normalized BLI-response greater than 0.5, the pair was considered non-competing and to bin to different epitopes. The normalized BLI-response for each of the antibody pairs are summarized in FIG. 119. The data show that each of the phage-derived mAbs binned to the same epitope as XENP19351 (as indicated by BLI-response below 0.5) and a different epitope than XENP19352 (as indicated by BLI-response greater than 0.5) suggesting that the phage-derived mAbs are blockers of TIGIT:TIGIT ligand interactions.

To confirm the above, we investigated the blocking of TIGIT binding to cell-surface CD112 and PVR in a cell-based assay. Indicated concentrations of phage-derived mAbs, positive control antibody XENP19351 (confirmed blocker of TIGIT:TIGIT ligand interactions), or negative control anti-RSV mAb XENP15074 were mixed with 1 µg/mL of a murine Fc fusion of human TIGIT (TIGIT-mFc) for 30 minutes at room temperature. CD112-transfected or PVR-transfected CHO cells were then added and incubated for 30 minutes at 4° C. Cells were washed and stained with anti-murine Fc-A647 antibody to detect TIGIT-mFc binding to CD112 or PVR on CHO cells, and analyzed by flow cytometry. Data depicting binding of TIGIT-mFc to CD112-transfected CHO cells or PVR-transfected CHO cells are respectively depicted in FIGS. 120A-B, and confirm that the phage-derived mAbs (including mAb based on 2A5B4) were able to block binding of TIGIT to both PVR and CD112. In another experiment performed similarly, percent blockade of PVR and CD112 were investigated, data for which are depicted in FIGS. 121A-B.

10B: Production of Prototype TIGIT-Targeted IL-10 Fusion Proteins

Anti-TIGIT variable regions as described above were used to construct the prototype TIGIT-targeted IL-10 fusion proteins described herein. Sequences for additional anti-TIGIT variable regions which may find use in the TIGIT-targeted IL-10 fusion proteins of the inventions are depicted in FIG. 122.

Plasmids coding for IL-10 components or the anti-TIGIT variable regions were constructed by standard gene synthesis, followed by subcloning into a pTT5 expression vector containing fusion partners (e.g., backbones and/or CH1/partial hinge as depicted in FIGS. 10, 11, and/or 12). Proteins were produced by transient transfection in HEK293E cells and were purified by a two-step purification process comprising protein A chromatography (GE Healthcare) and ion exchange chromatography.

Sequences for illustrative TIGIT-targeted IL-10 fusions in the "anti-X×scIL10-heteroFc" format are depicted in FIG. 123.

10C: TIGIT-Targeting Restores Potency of Reduced Potency IL-10-Fc Fusions on Induction of CD8+ T Cell Proliferation Next, the impact of TIGIT-targeting on reduced potency IL-10-Fc fusions was investigated. CD8$^+$ T cells were first incubated for 3 days with 10 µg/mL of immobilized anti-CD3 antibody (OKT3) and 2 µg/mL of immobilized anti-CD28 antibody (28.2) to induce IL-10 receptor expression on the CD8$^+$ T cells. CD8$^+$ T cells were then primed for 3 days with the indicated test articles followed by 6 hours stimulation by 1 µg/mL soluble anti-CD3 antibody. Cells were then stained with staining antibodies including anti-CD8-BV421 (SK1) on ice for 45-60 minutes. Next, cells were washed and stained with anti-Ki67-APC using eBioscience™ Foxp3/Transcription Factor Staining Buffer Set (ThermoFisher Scientific) and assessed by flow cytometry. Test articles investigated were XENP30007 (scIL10.104-Fc), XENP30008 (scIL10.105-Fc), XENP30010 (scIL10.107-Fc), XENP30523 (αTIGIT(2A5B4)× huIL10.104)), XENP30524 (αTIGIT(2A5B4)× huIL10.105)), and XENP30525 (αTIGIT(2A5B4)× huIL10.107)).

Data showing proliferation of CD8$^+$ T cells as indicated by percentage of CD8$^+$ T cells that were Ki67+ are depicted in FIG. 124. For each of the reduced potency IL-10-Fc fusions, potency on induction of CD8$^+$ T cell proliferation was restored by TIGIT-targeting. It is presumed that the CD8$^+$ T cells targeted for proliferation are TIGIT-expressing CD8$^+$ T cells similar to those that would be found in the tumor environment.

The examples set forth above are provided to give those of ordinary skill in the art a complete disclosure and description of how to make and use the embodiments of the compositions, systems and methods of the invention, and are not intended to limit the scope of what the inventors regard as their invention. Modifications of the above-described modes for carrying out the invention that are obvious to persons of skill in the art are intended to be within the scope of the following claims. All patents and publications mentioned in the specification are indicative of the levels of skill of those skilled in the art to which the invention pertains. All references cited in this disclosure are incorporated by reference to the same extent as if each reference had been incorporated by reference in its entirety individually.

All headings and section designations are used for clarity and reference purposes only and are not to be considered limiting in any way. For example, those of skill in the art will appreciate the usefulness of combining various aspects from different headings and sections as appropriate according to the spirit and scope of the invention described herein.

All references cited herein are hereby incorporated by reference herein in their entireties and for all purposes to the same extent as if each individual publication or patent or patent application was specifically and individually indicated to be incorporated by reference in its entirety for all purposes. Many modifications and variations of this application can be made without departing from its spirit and scope, as will be apparent to those skilled in the art. The specific embodiments and examples described herein are offered by way of example only, and the application is to be limited only by the terms of the appended claims, along with the full scope of equivalents to which the claims are entitled.

SEQUENCE LISTING (933 sequences)

SEQ ID NO: 1 - protein, 178 aa, Homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 2 - protein, 178 aa, Homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 3 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 4 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 5 - protein, 578 aa, Homo sapiens
MLPCLVVLLAALLSLRLGSDAHGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNREPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 6 - protein, 214 aa, Homo sapiens
HGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTN

SEQ ID NO: 7 - protein, 325 aa, Homo sapiens
MAWSLGSWLGGCLLVSALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYAFSPRNSLPQHLKEFLGHPHHNTLLFFSFPLSDENDVFDKLSVIAEDSESGKQNPGDSCSLGTPPGQGPQS

SEQ ID NO: 8 - protein, 201 aa, Homo sapiens
MVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPS

SEQ ID NO: 9 - protein, 178 aa, Mus musculus
MPGSALLCCLLLLTGMRISRGQYSREDNNCTHFPVGQSHMLLELRTAFSQVKTFFQTKDQLDNILLTDSLMQDFKGYLGCQALSEMIQFYLVEVMPQAEKHGPEIKEHLNSLGEKLKTLRMRLRRCHRFLPCENKSKAVEQVKSDFNKLQDQGVYKAMNEFDIFINCIEAYMMIKMKS

SEQ ID NO: 10 - protein, 160 aa, Mus musculus
SRGQYSREDNNCTHFPVGQSHMLLELRTAFSQVKTFFQTKDQLDNILLTDSLMQDFKGYLGCQALSEMIQFYLVEVMPQAEKHGPEIKEHLNSLGEKLKTLRMRLRRCHRFLPCENKSKAVEQVKSDFNKLQDQGVYKAMNEFDIFINCIEAYMMIKMKS

SEQ ID NO: 11 - protein, 575 aa, Mus musculus
MLSRLLPFLVTISSLSLEFIAYGTELPSPSYVWFEARFFQHILHWKPIPNQSESTYYEVALKQYGNSTWNDIHICRKAQALSCDLTTFTLDLYHRSYGYRARVRAVDNSQYSNWTTTETRFTVDEVILTVDSVTLKAMDGIIYGTIHPPRPTITPAGDEYEQVFKDLRVYKISIRKFSELKNATKRVKQETFTLTVPIGVRKFCVKVLPRLESRINKAEWSEEQCLLITTEQYFTVTNLSILVISMLLFCGILVCLVLQWYIRHPGKLPTVLVFKKPHDFFPANPLCPETPDAIHIVDLEVFPKVSLELRDSVLHGSTDSGFGSGKPSLQTEESQFLLPGSHPQIQGTLGKEESPGLQATCGDNTDSGICLQEPGLHSSMGPAWKQQLGYTHQDQDDSDVNLVQNSPGQPKYTQDASALGHVCLLEPKAPEEKDQVMVTFQGYQKQTRWKAEAAGPAECLDEEIPLTDAFDPELGVHLQDDLAWPPPALAAGYLKQESQGMASAPPGTPSRQWNQLTEEWSLLGVVSCEDLSIESWRFAHKLDPLDCGAAPGGLLDSLGSNLVTLPLISSLQVEE

SEQ ID NO: 12 - protein, 225 aa, Mus musculus
LEFIAYGTELPSPSYVWFEARFFQHILHWKPIPNQSESTYYEVALKQYGNSTWNDIHICRKAQALSCDLTTFTLDLYHRSYGYRARVRAVDNSQYSNWTTTETRFTVDEVILTVDSVTLKAMDGIIYGTIHPPRPTITPAGDEYEQVFKDLRVYKISIRKFSELKNATKRVKQETFTLTVPIGVRKFCVKVLPRLESRINKAEWSEEQCLLITTEQYFTVTNLSI

SEQ ID NO: 13 - protein, 349 aa, Mus musculus
MAPCVAGWLGGFLLVPALGMIPPPEKVRMNSVNFKNILQWEVPAFPKTNLTFTAQYESYRSFQDHCKRTASTQCDFSHLSKYGDYTVRVRAELADEHSEWVNVTFCPVEDTIIGPPEMQIESLAESLHLRFSAPQIENEPETWTLKNIYDSWAYRVQYWKNGTNEKFQVVSPYDSEVLRNLEPWTTYCIQVQGFLLDQNRTGEWSEPICERTGNDEITPSWIVAIILIVSVLVVFLFLLGCFVVLWLIYKKTKHTFRSGTSLPQHLKEFLGHPHHSTFLLFSFPPPEEAEVFDKLSIISEESEGSKQSPEDNCASEPPSDPGPRELESKDEAPSPPHDDPKLLTSTSEV

SEQ ID NO: 14 - protein, 201 aa, Mus musculus
MIPPPEKVRMNSVNFKNILQWEVPAFPKTNLTFTAQYESYRSFQDHCKRTASTQCDFSHLSKYGDYTVRVRAELADEHSEWVNVTFCPVEDTIIGPPEMQIESLAESLHLRFSAPQIENEPETWTLKNIYDSWAYRVQYWKNGTNEKFQVVSPYDSEVLRNLEPWTTYCIQVQGFLLDQNRTGEWSEPICERTGNDEITPS

SEQ ID NO: 15 - protein, 178 aa, Macaca fascicularis
MHSSALLCCLVLLTGVRASPGQGTQSENSCTRFPGNLPHMLRDLRDAFSRVKTFFQMKDQLDNILLKESLLEDFKGYLGCQALSEMIQFYLEEVMPQAENHDPDIKEHVNSLGENLKTLRLRLRRCHRFLPCENKSKAVEQVKNAFSKLQEKGVYKAMSEFDIFINYIEAYMTMKIRN

SEQ ID NO: 16 - protein, 160 aa, Macaca fascicularis
SPGQGTQSENSCTRFPGNLPHMLRDLRDAFSRVKTFFQMKDQLDNILLKESLLEDFKGYLGCQALSEMIQFYLEEVMPQAENHDPDIKEHVNSLGENLKTLRLRLRRCHRFLPCENKSKAVEQVKNAFSKLQEKGVYKAMSEFDIFINYIEAYMTMKIRN

SEQ ID NO: 17 - protein, 576 aa, Macaca fascicularis
MLPRLVVLLAAFLSRRLGSDAHGTELPSPPSVWFEAEFFHHILHWTPIPNQSESTCYEVALLRYGTGRWNSISNCSQALSYDLTAVTLDLYRSNGYRARVRAVDGSRHSNWTVTNTRFSLDEVTLTVGSVKLEIHNGFILGKIQPPRPKMAPANDTYESIFSHFREYEIAIRKVPGNFTFTHKKVKHENFSLLTSGEVGEFCVQVKPSVTSRTNKGMWSKEECVSLTRQYFTVTNVIIFFAFVLLLSGALAYCLALQLYVRRRKKLPRVLLFKKPNAFIFISQRPSPETQDTIHPLDEEAFLKVSPELRNSDLHGSTDSGFGSTKPSLQTEEPQFLLPDPHPQADRTLGNGEPPELGDSCSSGSSNSTDSGICLQEPSLSPSTGPTWEQQVGSDSRGQDDSGIGLVQNSEGQAGDTQGGSALGHDSPPEPEVPAEQDPTAVVFRGYLRQTRCAEEKATKTGCLEEELPLTGGLGPKFRGCLDDEAGLHPSALAKGYLKQDPLEMTLASSGAPAEQWNQPTEEWSLLALSSCSDLGTSDWSFAHDLAPLGCVAAPDGLLGSFNSDLVTLPLISSLHE

SEQ ID NO: 18 - protein, 313 aa, Macaca fascicularis
MARSLGSWLGGCLLVSALGMVPPPENVRMNSVNFKNILQWESPAFAKGNLTFTAQYLSYRIFQDKCTSTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVQGFLPDRNKTGEWSEPVCEKTTSDETVPSWMVAIILMASVFVVCLALLGCFALLWCIYKKTKYTFSPGNSLPQHLKEFSFPFSDENDVFDKLSVIAEDSESSKQNPDDSCSLGTPSGQGPQS

SEQ ID NO: 19 - protein, 170 aa, Epstein-Barr virus
MERRLVVTLQCLVLLYLAPECGGTDQCDNFPQMLRDLRDAFSRVKTFFQTKDEVDNLLLKESLLEDFKGYLGCQALSEMIQFYLEEVMPQAENQDPEAKDHVNSLGENLKTLRLRLRRCHRFLPCENKSKAVEQIKNAFNKLQEKGIYKAMSEFDIFINYIEAYMTIKAR

SEQ ID NO: 20 - protein, 147 aa, Epstein-Barr virus
TDQCDNFPQMLRDLRDAFSRVKTFFQTKDEVDNLLLKESLLEDFKGYLGCQALSEMIQFYLEEVMPQAENQDPEAKDHVNSLGENLKTLRLRLRRCHRFLPCENKSKAVEQIKNAFNKLQEKGIYKAMSEFDIFINYIEAYMTIKAR

SEQ ID NO: 21 - protein, 116 aa, Artificial Sequence
  Description of Artificial Sequence: Synthetic polypeptide
  hIL-10(A-D)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCEN

SEQ ID NO: 22 - protein, 44 aa, Artificial Sequence
  Description of Artificial Sequence: Synthetic polypeptide
  hIL-10(E-F)
KSKAVEQVKNAFNKLQEKGIYKAMSEFDIFINYIEAYMTMKIRN

SEQ ID NO: 23 - protein, 320 aa, Artificial Sequence
  Description of Artificial Sequence: Synthetic polypeptide
  scIL-10
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 24 - protein, 166 aa, Artificial Sequence
  Description of Artificial Sequence: Synthetic polypeptide
  IL10M1
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 25 - protein, 231 aa, Artificial Sequence
  Description of Artificial Sequence: Synthetic polypeptide
  XENP30005 Chain 1 - empty_Fc(216)_IgG1_pI(-)_Isosteric_A _C220S/PVA_/S267K/L368D/K370S
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 26 - protein, 560 aa, Artificial Sequence
  Description of Artificial Sequence: Synthetic polypeptide
  XENP30005 Chain 2 - huIL10.102_huIL10.102_(G4S)2_IgG1 _C220S/PVA_/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27 - protein, 231 aa, Artificial Sequence; identical to SEQ ID NO: 25
  Description of Artificial Sequence: Synthetic polypeptide
  XENP30008 Chain 1 - empty_Fc(216)_IgG1_pI(-)_Isosteric_A _C220S/PVA_/S267K/L368D/K370S

SEQ ID NO: 28 - protein, 560 aa, Artificial Sequence
  Description of Artificial Sequence: Synthetic polypeptide
  XENP30008 Chain 2 - huIL10.105_huIL10.105_(G4S)2_IgG1 _C220S/PVA_/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFNIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29 - protein, 231 aa, Artificial Sequence; identical to SEQ ID NO: 25
  Description of Artificial Sequence: Synthetic polypeptide
  XENP30013 Chain 1 - empty_Fc(216)_IgG1_pI(-)_Isosteric_A _C220S/PVA_/S267K/L368D/K370S

SEQ ID NO: 30 - protein, 560 aa, Artificial Sequence
  Description of Artificial Sequence: Synthetic polypeptide
  XENP30013 Chain 2 - huIL10.110_huIL10.110_(G4S)2_IgG1 _C220S/PVA_/S267K/S364K/E357Q
SPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 31 - protein, 5 aa, Artificial Sequence
  Description of Artificial Sequence: Synthetic peptide
GGGGS

SEQ ID NO: 32 - protein, 10 aa, Artificial Sequence
  Description of Artificial Sequence: Synthetic peptide
GGGGSGGGGS

SEQ ID NO: 33 - protein, 15 aa, Artificial Sequence
  Description of Artificial Sequence: Synthetic peptide
GGGGSGGGGSGGGGS

SEQ ID NO: 34 - protein, 10 aa, Artificial Sequence
  Description of Artificial Sequence: Synthetic peptide
  MISC_FEATURE (1)..(10): This sequence may encompass 0-5 "Gly Ser" repeating units
GSGSGSGSGS

SEQ ID NO: 35 - protein, 25 aa, Artificial Sequence
  Description of Artificial Sequence: Synthetic peptide
  MISC_FEATURE (1)..(25): This sequence may encompass 0-5 "Gly Ser Gly Gly" repeating units
GSGGSGSGGSGSGGSGSGGSGSGGS

SEQ ID NO: 36 - protein, 25 aa, Artificial Sequence
  Description of Artificial Sequence: Synthetic peptide
  MISC_FEATURE (1)..(25): This sequence may encompass 0-5 "Gly Gly Gly Gly Ser" repeating units
GGGGSGGGGSGGGGSGGGGSGGGGS

SEQ ID NO: 37 - protein, 20 aa, Artificial Sequence
  Description of Artificial Sequence: Synthetic peptide
  MISC_FEATURE (1)..(20): This sequence may encompass 0-5 " Gly Gly Gly Ser" repeating units
GGGSGGGSGGGSGGGSGGGS

SEQ ID NO: 38 - protein, 20 aa, Artificial Sequence
  Description of Artificial Sequence: Synthetic peptide
GKPGSGKPGSGKPGSGKPGS

SEQ ID NO: 39 - protein, 6 aa, Artificial Sequence
  Description of Artificial Sequence: Synthetic peptide
GGGSGG

SEQ ID NO: 40 - protein, 6 aa, Artificial Sequence
  Description of Artificial Sequence: Synthetic peptide
PGGSGG

SEQ ID NO: 41 - protein, 6 aa, Artificial Sequence
  Description of Artificial Sequence: Synthetic peptide
GPGSGG

SEQ ID NO: 42 - protein, 6 aa, Artificial Sequence
  Description of Artificial Sequence: Synthetic peptide
GGPSGG

SEQ ID NO: 43 - protein, 6 aa, Artificial Sequence
  Description of Artificial Sequence: Synthetic peptide
GGGPGG

SEQ ID NO: 44 - protein, 6 aa, Artificial Sequence
  Description of Artificial Sequence: Synthetic peptide
GGGSPG

SEQ ID NO: 45 - protein, 6 aa, Artificial Sequence
  Description of Artificial Sequence: Synthetic peptide
GGGSGP

SEQ ID NO: 46 - protein, 5 aa, Artificial Sequence
  Description of Artificial Sequence: Synthetic peptide
GGGGG

SEQ ID NO: 47 - protein, 4 aa, Artificial Sequence
  Description of Artificial Sequence: Synthetic peptide
GGGG

SEQ ID NO: 48 - protein, 231 aa, Artificial Sequence
  Description of Artificial Sequence: Synthetic polypeptide
  Homodimeric Fc Backbone 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 49 - protein, 231 aa, Artificial Sequence
  Description of Artificial Sequence: Synthetic polypeptide
  Homodimeric Fc Backbone 2
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 50 - protein, 229 aa, Artificial Sequence
  Description of Artificial Sequence: Synthetic polypeptide
  Homodimeric Fc Backbone 3
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 51 - protein, 228 aa, Artificial Sequence
  Description of Artificial Sequence: Synthetic polypeptide
  Homodimeric Fc Backbone 4
ERKCCVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 52 - protein, 231 aa, Artificial Sequence
  Description of Artificial Sequence: Synthetic polypeptide
  Heterodimeric Fc Backbone 1 monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 53 - protein, 231 aa, Artificial Sequence; identical to SEQ ID NO: 25
  Description of Artificial Sequence: Synthetic polypeptide
  Heterodimeric Fc Backbone 1 monomer 2

SEQ ID NO: 54 - protein, 231 aa, Artificial Sequence
  Description of Artificial Sequence: Synthetic polypeptide
  Heterodimeric Fc Backbone 2 monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 55 - protein, 231 aa, Artificial Sequence; identical to SEQ ID NO: 25
  Description of Artificial Sequence: Synthetic polypeptide
  Heterodimeric Fc Backbone monomer 2

SEQ ID NO: 56 - protein, 231 aa, Artificial Sequence; identical to SEQ ID NO: 54
  Description of Artificial Sequence: Synthetic polypeptide
  Heterodimeric Fc Backbone 3 monomer 1

SEQ ID NO: 57 - protein, 231 aa, Artificial Sequence
  Description of Artificial Sequence: Synthetic polypeptide
  Heterodimeric Fc Backbone 3 monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 58 - protein, 231 aa, Artificial Sequence
  Description of Artificial Sequence: Synthetic polypeptide
  Heterodimeric Fc Backbone 4 monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 59 - protein, 231 aa, Artificial Sequence
  Description of Artificial Sequence: Synthetic polypeptide
  Heterodimeric Fc Backbone 4 monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKGFYPSDIAVEWESDGQPENNYKTTPPVLDSDGSFFLYSKLEVDKSRWEQGDVFSCSVMHEALHNHYTQKSLSLSPGK

SEQ ID NO: 60 - protein, 231 aa, Artificial Sequence
  Description of Artificial Sequence: Synthetic polypeptide
  Heterodimeric Fc Backbone 5 monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - protein, 231 aa, Artificial Sequence
  Description of Artificial Sequence: Synthetic polypeptide
  Heterodimeric Fc Backbone 5 monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 62 - protein, 231 aa, Artificial Sequence
  Description of Artificial Sequence: Synthetic polypeptide
  Heterodimeric Fc Backbone 6 monomer 1
EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 63 - protein, 231 aa, Artificial Sequence
  Description of Artificial Sequence: Synthetic polypeptide
  Heterodimeric Fc Backbone 6 monomer 2
EPKSSDKTHTCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 64 - protein, 231 aa, Artificial Sequence
  Description of Artificial Sequence: Synthetic polypeptide
  Heterodimeric Fc Backbone 7 monomer 1
EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 65 - protein, 231 aa, Artificial Sequence
  Description of Artificial Sequence: Synthetic polypeptide
  Heterodimeric Fc Backbone 7 monomer 2
EPKSSDKTHTCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 66 - protein, 229 aa, Artificial Sequence
  Description of Artificial Sequence: Synthetic polypeptide
  Heterodimeric Fc Backbone 8 monomer 1
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 67 - protein, 229 aa, Artificial Sequence
  Description of Artificial Sequence: Synthetic polypeptide
  Heterodimeric Fc Backbone 8 monomer 2
ESKYGPPCPPCPAPEFLGGPSVFLFPPKPKDTLMISRTPEVTCVVVDVSQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSRLTVDKSRWEEGDVFSCSVMHEALHNHYTQKSLSLSLGK

SEQ ID NO: 68 - protein, 228 aa, Artificial Sequence
  Description of Artificial Sequence: Synthetic polypeptide
  Heterodimeric Fc Backbone 9 monomer 1
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 69 - protein, 228 aa, Artificial Sequence
  Description of Artificial Sequence: Synthetic polypeptide
  Heterodimeric Fc Backbone 9 monomer 2
ERKCCVECPPCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 70 - protein, 228 aa, Artificial Sequence
  Description of Artificial Sequence: Synthetic polypeptide
  Heterodimeric Fc Backbone 10 monomer 1
ERKCCVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 71 - protein, 228 aa, Artificial Sequence
  Description of Artificial Sequence: Synthetic polypeptide
  Heterodimeric Fc Backbone 10 monomer 2
ERKCCVECPPCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 72 - protein, 231 aa, Artificial Sequence
  Description of Artificial Sequence: Synthetic polypeptide
  Heterodimeric Fc Backbone 11 monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 73 - protein, 231 aa, Artificial Sequence
  Description of Artificial Sequence: Synthetic polypeptide
  Heterodimeric Fc Backbone 11 monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 74 - protein, 231 aa, Artificial Sequence; identical to SEQ ID NO: 25
  Description of Artificial Sequence: Synthetic polypeptide
  Heterodimeric Fc Backbone 12 monomer 1

SEQ ID NO: 75 - protein, 231 aa, Artificial Sequence
  Description of Artificial Sequence: Synthetic polypeptide
  Heterodimeric Fc Backbone 12 monomer 2
ERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - protein, 98 aa, Artificial Sequence
  Description of Artificial Sequence: Synthetic polypeptide
  IgG1 CH1 + partial hinge (+ side)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 77 - protein, 98 aa, Artificial Sequence
  Description of Artificial Sequence: Synthetic polypeptide
  IgG2 CH1 + partial hinge (+ side)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTV

SEQ ID NO: 78 - protein, 98 aa, Artificial Sequence
  Description of Artificial Sequence: Synthetic polypeptide
  IgG4 CH1 + partial hinge (+ side)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRV

SEQ ID NO: 79 - protein, 98 aa, Artificial Sequence
  Description of Artificial Sequence: Synthetic polypeptide
  IgG1 CH1 + partial hinge (- side)
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKV

SEQ ID NO: 80 - protein, 98 aa, Artificial Sequence
  Description of Artificial Sequence: Synthetic polypeptide
  IgG2 CH1 + partial hinge (- side)
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTV

SEQ ID NO: 81 - protein, 98 aa, Artificial Sequence
  Description of Artificial Sequence: Synthetic polypeptide
  IgG4 CH1 + partial hinge (- side)
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRV

SEQ ID NO: 82 - protein, 107 aa, Artificial Sequence [sequence omitted]

SEQ ID NO: 83 - protein, 106 aa, Artificial Sequence
  Description of Artificial Sequence: Synthetic polypeptide
  Constant Light Chain - Lambda
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 84 - protein, 391 aa, Artificial Sequence
  Description of Artificial Sequence: Synthetic polypeptide
  XENP24628 huIL10_Fc(216)_IgG1_PVA_/S267K
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 85 - protein, 396 aa, Artificial Sequence
  Description of Artificial Sequence: Synthetic polypeptide
  XENP24629 huIL10_(G4S)_Fc(216)_IgG1_PVA_/S267K
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 86 - protein, 401 aa, Artificial Sequence
  Description of Artificial Sequence: Synthetic polypeptide
  XENP24630 huIL10_(G4S)2_Fc(216)_IgG1_PVA_/S267K
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - protein, 406 aa, Artificial Sequence
  Description of Artificial Sequence: Synthetic polypeptide
  XENP24631 huIL10_(G4S)3_Fc(216)_IgG1_PVA_/S267K
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 395 aa, Artificial Sequence
  Description of Artificial Sequence: Synthetic polypeptide
  XENP24632 empty-Fc(216-446)_IgG1_C220S/PVA_/S267K_(G4S) _huIL-10
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 89 - protein, 400 aa, Artificial Sequence
  Description of Artificial Sequence: Synthetic polypeptide
  XENP24633 empty-Fc(216-446)_IgG1_C220S/PVA_/S267K_(G4S)2 _huIL-10
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 90 - protein, 405 aa, Artificial Sequence
  Description of Artificial Sequence: Synthetic polypeptide
  XENP24634 empty-Fc(216-446)_IgG1_C220S/PVA_/S267K_(G4S)3 _huIL-10
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 91 - protein, 231 aa, Artificial Sequence; identical to SEQ ID NO: 25
  Description of Artificial Sequence: Synthetic polypeptide
  XENP25955 Chain 1 - empty_Fc(216)_IgG1_pI(-)_Isosteric_A _C220S/PVA_/S267KL368D/K370S

SEQ ID NO: 92 - protein, 391 aa, Artificial Sequence
  Description of Artificial Sequence: Synthetic polypeptide
  XENP25955 Chain 2 - huIL10_(G4S)2-Fc(216)_IgG1_C220S/PVA _/S267K/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 93 - protein, 160 aa, Artificial Sequence; identical to SEQ ID NO: 4
  Description of Artificial Sequence: Synthetic polypeptide
  XENP25955 Chain 3 - huIL10

SEQ ID NO: 94 - protein, 561 aa, Artificial Sequence
  Description of Artificial Sequence: Synthetic polypeptide
  XENP25238 Chain 1 - huIL10_huIL10_(G4S)2_Fc(216)_IgG1_pI(-) _Isosteric_A_C220S/PVA_/S267K/L368D/K370S
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 95 - protein, 231 aa, Artificial Sequence; identical to SEQ ID NO: 52
  Description of Artificial Sequence: Synthetic polypeptide
  XENP25238 Chain 2 - empty_Fc(216)_IgG1_C220S/PVA _/S267K/S364K/E357Q

SEQ ID NO: 96 - protein, 566 aa, Artificial Sequence
  Description of Artificial Sequence: Synthetic polypeptide
  XENP25239 Chain 1 - huIL10_(G4S)_huIL10_(G4S)2_Fc(216)_IgG1 _pI(-)_Isosteric_A_C220S/PVA_/S267K/L368D/K370S
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 97 - protein, 231 aa, Artificial Sequence; identical to SEQ ID NO: 52
  Description of Artificial Sequence: Synthetic polypeptide
  XENP25239 Chain 2 - empty_Fc(216)_IgG1_C220S/PVA _/S267K/S364K/E357Q

SEQ ID NO: 98 - protein, 571 aa, Artificial Sequence
  Description of Artificial Sequence: Synthetic polypeptide
  XENP25240 Chain 1 - huIL10_(G4S)2_huIL10_(G4S)2_Fc(216)_IgG1 _pI(-)_Isosteric_A_C220S/PVA_/S267K/L368D/K370S
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 99 - protein, 231 aa, Artificial Sequence; identical to SEQ ID NO: 52
  Description of Artificial Sequence: Synthetic polypeptide
  XENP25240 Chain 2 - empty_Fc(216)_IgG1_C220S/PVA _/S267K/S364K/E357Q

SEQ ID NO: 100 - protein, 576 aa, Artificial Sequence
  Description of Artificial Sequence: Synthetic polypeptide
  XENP25241 Chain 1 - huIL10_(G4S)3_huIL10_(G4S)2_Fc(216)_IgG1 _pI(-)_Isosteric_A_C220S/PVA_/S267K/L368D/K370S
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 101 - protein, 231 aa, Artificial Sequence; identical to SEQ ID NO: 52
  Description of Artificial Sequence: Synthetic polypeptide
  XENP25241 Chain 2 - empty_Fc(216)_IgG1_C220S/PVA _/S267K/S364K/E357Q

SEQ ID NO: 102 - protein, 231 aa, Artificial Sequence; identical to SEQ ID NO: 25
  Description of Artificial Sequence: Synthetic polypeptide
  XENP25880 Chain 1 - empty_Fc(216)_IgG1_pI(-)_Isosteric_A _C220S/PVA_/S267K/L368D/K370S

SEQ ID NO: 103 - protein, 561 aa, Artificial Sequence
  Description of Artificial Sequence: Synthetic polypeptide
  XENP25880 Chain 2 - huIL10_huIL10_(G4S)2_IgG1_C220S/PVA _/S267K/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - protein, 231 aa, Artificial Sequence; identical to SEQ ID NO: 25
  Description of Artificial Sequence: Synthetic polypeptide
  XENP28295 Chain 1 - empty_Fc(216)_IgG1_pI(-)_Isosteric_A_PVA _/S267K/L368D/K370S

SEQ ID NO: 105 - protein, 551 aa, Artificial Sequence
  Description of Artificial Sequence: Synthetic polypeptide
  XENP28295 Chain 2 - huIL10_huIL10_Fc(216)_IgG1_C220S/PVA _/S267K/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 106 - protein, 231 aa, Artificial Sequence; identical to SEQ ID NO: 25
  Description of Artificial Sequence: Synthetic polypeptide
  XENP28740 Chain 1 - empty_Fc(216)_pI(-)_Isosteric_A_C220S/PVA _/S267K/L368D/K370S

SEQ ID NO: 107 - protein, 565 aa, Artificial Sequence
  Description of Artificial Sequence: Synthetic polypeptide
  XENP28740 Chain 2 - Fc(216)_IgG1_C220S/PVA _/S267K/S364K/E357Q/K447del_(G4S)3_huIL10_huIL10
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 108 - protein, 231 aa, Artificial Sequence; identical to SEQ ID NO: 25
  Description of Artificial Sequence: Synthetic polypeptide
  XENP14246 Chain 1 - empty-Fc(216)_IgG1_PVA_/S267K_pI(-) _Isosteric_A_L368D/K370S

SEQ ID NO: 109 - protein, 397 aa, Artificial Sequence
  Description of Artificial Sequence: Synthetic polypeptide
  XENP14246 Chain 2 - huIL10M1_Fc(216)_IgG1_C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 110 - protein, 231 aa, Artificial Sequence; identical to SEQ ID NO: 25
  Description of Artificial Sequence: Synthetic polypeptide
  XENP14247 Chain 1 - empty-Fc(216)_IgG1_PVA_/S267K_pI(-) _Isosteric_A_L368D/K370S

SEQ ID NO: 111 - protein, 412 aa, Artificial Sequence
  Description of Artificial Sequence: Synthetic polypeptide
  XENP14247 Chain 2 - Fc(216)_IgG1_C220S/S364K/E357Q_(G4S)3 _huIL10M1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 112 - protein, 397 aa, Artificial Sequence
  Description of Artificial Sequence: Synthetic polypeptide
  XENP25236 huIL10M1_Fc(216)_IgG1_C220S/PVA_/S267K
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 113 - protein, 412 aa, Artificial Sequence
  Description of Artificial Sequence: Synthetic polypeptide
  XENP25237 empty-Fc(216)_IgG1_C220S/PVA_/S267K_(G4S)3_huIL10M1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 114 - protein, 231 aa, Artificial Sequence; identical to SEQ ID NO: 25
  Description of Artificial Sequence: Synthetic polypeptide
  XENP26887 Chain 1 - empty_Fc(216)_IgG1_pI(-)_Isosteric_A _C220S/PVA_/S267K/L368D/K370S

SEQ ID NO: 115 - protein, 582 aa, Artificial Sequence
  Description of Artificial Sequence: Synthetic polypeptide
  XENP26887 Chain 2 - huIL10M1_(G4S)3_huIL10M1_(G4S)2_Fc(222) _IgG1_C220S/PVA_/S267K/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRNGGGGSGGGGSGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRNGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 116 - protein, 347 aa, Artificial Sequence
  Description of Artificial Sequence: Synthetic polypeptide
  XENP25242 Chain 1 - huIL10(19-134)_Fc(216)_IgG1_pI(-) _Isosteric_A_C220S/PVA_/S267K/L368D/K370S
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 117 - protein, 275 aa, Artificial Sequence
  Description of Artificial Sequence: Synthetic polypeptide
  XENP25242 Chain 2 - huIL10(135-178)_Fc(216)_IgG1_C220S/PVA _/S267K/S364K/E357Q
KSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - protein, 352 aa, Artificial Sequence
  Description of Artificial Sequence: Synthetic polypeptide
  XENP25243 Chain 1 - huIL10(19-134)_(G4S)_Fc(216)_IgG1_pI(-) _Isosteric_A_C220S/PVA_/S267K/L368D/K370S
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 119 - protein, 280 aa, Artificial Sequence
  Description of Artificial Sequence: Synthetic polypeptide
  XENP25243 Chain 2 - huIL10(135-178)_(G4S)_Fc(216)_IgG1 _C220S/PVA_/S267K/S364K/E357Q
KSKAVEQVKNAFNKLQEKGIYKAMSEFDIFINYIEAYMTMKIRNGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 120 - protein, 357 aa, Artificial Sequence
  Description of Artificial Sequence: Synthetic polypeptide
  XENP25244 Chain 1 - huIL10(19-134)_(G4S)2_Fc(216)_IgG1_pI(-) _Isosteric_A_C220S/PVA_/S267K/L368D/K370S
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 121 - protein, 285 aa, Artificial Sequence
  Description of Artificial Sequence: Synthetic polypeptide
  XENP25244 Chain 2 - huIL10(135-178)_(G4S)2_Fc(216)_IgG1 _C220S/PVA_/S267K/S364K/E357Q
KSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - protein, 361 aa, Artificial Sequence
  Description of Artificial Sequence: Synthetic polypeptide
  XENP25879 Chain 1 - empty-Fc(216-446)_IgG1_PVA_/S267K_pI(-) _Isosteric_A_L368D/K370S_(G4S)3_huIL10(19-134)
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGGGGGSGGGGSGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCEN

SEQ ID NO: 123 - protein, 289 aa, Artificial Sequence
  Description of Artificial Sequence: Synthetic polypeptide
  XENP25879 Chain 2 - empty-Fc(216-446)_IgG1_C220S/S364K/E357Q _(G4S)3_huIL10(135-178)
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSKSKAVEQVKNAFNKLQEKGIYKAMSEFDIFINYIEAYMTMKIRN

SEQ ID NO: 124 - protein, 160 aa, Artificial Sequence
  Description of Artificial Sequence: Synthetic polypeptide
  IL-10(N21D)
SPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 125 - protein, 160 aa, Artificial Sequence
  Description of Artificial Sequence: Synthetic polypeptide
  IL-10(D28N)
SPGQGTQSENSCTHFPGNLPNMLRDLRNAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 126 - protein, 160 aa, Artificial Sequence
  Description of Artificial Sequence: Synthetic polypeptide
  IL-10(Q38E)
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 127 - protein, 160 aa, Artificial Sequence
  Description of Artificial Sequence: Synthetic polypeptide
  IL-10(M39T)
SPGQGTQSENSCTHFPGNLPNMLRDLRDAFSRVKTFFQTKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 128 - protein, 160 aa, Artificial Sequence
  Description of Artificial Sequence: Synthetic polypeptide
  IL-10(D41N)
SPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 129 - protein, 160 aa, Artificial Sequence
  Description of Artificial Sequence: Synthetic polypeptide
  IL-10(Q42E)
SPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 130 - protein, 160 aa, Artificial Sequence
  Description of Artificial Sequence: Synthetic polypeptide
  IL-10(L43V)
SPGQGTQSENSCTHFPGNLPNMLRDLRDAFSRVKTFFQMKDQVDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 131 - protein, 160 aa, Artificial Sequence
  Description of Artificial Sequence: Synthetic polypeptide
  IL-10(D44N)
SPGQGTQSENSCTHFPGNLPNMLRDLRDAFSRVKTFFQMKDQLNNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 132 - protein, 160 aa, Artificial Sequence
  Description of Artificial Sequence: Synthetic polypeptide
  IL-10(N45D)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 133 - protein, 160 aa, Artificial Sequence
  Description of Artificial Sequence: Synthetic polypeptide
  IL-10(I87A)
SPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCLRFLPCENKSKAVEQVKNAFNKLQEKGIYKAMSEFDIFINYIEAYMTMKIRN

SEQ ID NO: 134 - protein, 160 aa, Artificial Sequence
  Description of Artificial Sequence: Synthetic polypeptide
  IL-10(E142Q)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRN

SEQ ID NO: 135 - protein, 160 aa, Artificial Sequence
  Description of Artificial Sequence: Synthetic polypeptide
  IL-10(D144N)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRN

SEQ ID NO: 136 - protein, 160 aa, Artificial Sequence
  Description of Artificial Sequence: Synthetic polypeptide
  IL-10(E151Q)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRN

SEQ ID NO: 137 - protein, 160 aa, Artificial Sequence
  Description of Artificial Sequence: Synthetic polypeptide
  IL-10(Q38E/D41N)
SPGQGTQSENSCTHFPGNLPNMLRDLRDAFSRVKTFFEMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 138 - protein, 160 aa, Artificial Sequence
  Description of Artificial Sequence: Synthetic polypeptide
  IL-10(Q38E/Q42E)
SPGQGTQSENSCTHFPGNLPNMLRDLRDAFSRVKTFFEMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 139 - protein, 160 aa, Artificial Sequence
  Description of Artificial Sequence: Synthetic polypeptide
  IL-10(Q38E/N45D)
SPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 140 - protein, 160 aa, Artificial Sequence
  Description of Artificial Sequence: Synthetic polypeptide
  IL-10(Q38E/E142Q)
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRN

SEQ ID NO: 141 - protein, 160 aa, Artificial Sequence
  Description of Artificial Sequence: Synthetic polypeptide
  IL-10(Q38E/D144N)
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRN

SEQ ID NO: 142 - protein, 160 aa, Artificial Sequence
  Description of Artificial Sequence: Synthetic polypeptide
  IL-10(D41N/Q42E)
SPGQGTQSENSCTHFPGNLPNMLRDLRDAFSRVKTFFQMKNELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 143 - protein, 160 aa, Artificial Sequence
  Description of Artificial Sequence: Synthetic polypeptide
  IL-10(D41N/N45D)
SPGQGTQSENSCTHFPGNLPNMLRDLRDAFSRVKTFFQMKNQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 144 - protein, 160 aa, Artificial Sequence
  Description of Artificial Sequence: Synthetic polypeptide
  IL-10(D41N/E142Q)
SPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRN

SEQ ID NO: 145 - protein, 160 aa, Artificial Sequence
  Description of Artificial Sequence: Synthetic polypeptide
  IL-10(D41N/D144N)
SPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRN

SEQ ID NO: 146 - protein, 160 aa, Artificial Sequence
  Description of Artificial Sequence: Synthetic polypeptide
  IL-10(Q42E/N45D)
SPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 147 - protein, 160 aa, Artificial Sequence
  Description of Artificial Sequence: Synthetic polypeptide
  IL-10(Q42E/E142Q)
SPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRN

SEQ ID NO: 148 - protein, 160 aa, Artificial Sequence
  Description of Artificial Sequence: Synthetic polypeptide
  IL-10(Q42E/D144N)
SPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRN

SEQ ID NO: 149 - protein, 160 aa, Artificial Sequence
  Description of Artificial Sequence: Synthetic polypeptide
  IL-10(N45D/E142Q)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRN

SEQ ID NO: 150 - protein, 160 aa, Artificial Sequence
  Description of Artificial Sequence: Synthetic polypeptide
  IL-10(N45D/D144N)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRN

SEQ ID NO: 151 - protein, 160 aa, Artificial Sequence
  Description of Artificial Sequence: Synthetic polypeptide
  IL-10(E142Q/D144N)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFNIFINYIEAYMTMKIRN

SEQ ID NO: 152 - protein, 160 aa, Artificial Sequence
  Description of Artificial Sequence: Synthetic polypeptide
  IL-10(N21D/Q42E)
SPGQGTQSENSCTHFPGNLPDMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 153 - protein, 160 aa, Artificial Sequence
  Description of Artificial Sequence: Synthetic polypeptide
  IL-10(N21D/N45D)
SPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 154 - protein, 160 aa, Artificial Sequence
  Description of Artificial Sequence: Synthetic polypeptide
  IL-10(N21D/E151Q)
SPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRN

SEQ ID NO: 155 - protein, 160 aa, Artificial Sequence
  Description of Artificial Sequence: Synthetic polypeptide
  IL-10(N21D/N45E)
SPGQGTQSENSCTHFPGNLPDMLRDLRDAFSRVKTFFQMKDQLDELLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 156 - protein, 160 aa, Artificial Sequence
  Description of Artificial Sequence: Synthetic polypeptide
  IL-10(Q42E/E151Q)
SPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRN

SEQ ID NO: 157 - protein, 160 aa, Artificial Sequence
  Description of Artificial Sequence: Synthetic polypeptide
  IL-10(N45D/E151Q)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRN

SEQ ID NO: 158 - protein, 160 aa, Artificial Sequence
  Description of Artificial Sequence: Synthetic polypeptide
  IL-10(N21D/Q42E/N45D)
SPGQGTQSENSCTHFPGNLPDMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 159 - protein, 160 aa, Artificial Sequence
  Description of Artificial Sequence: Synthetic polypeptide
  IL-10(N21D/Q42E/E151Q)
SPGQGTQSENSCTHFPGNLPDMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRN

SEQ ID NO: 160 - protein, 160 aa, Artificial Sequence
  Description of Artificial Sequence: Synthetic polypeptide
  IL-10(Q42E/N45D/E151Q)
SPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRN

SEQ ID NO: 161 - protein, 160 aa, Artificial Sequence
  Description of Artificial Sequence: Synthetic polypeptide
  IL-10(N21D/Q42E/N45E)
SPGQGTQSENSCTHFPGNLPDMLRDLRDAFSRVKTFFQMKDELDELLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 162 - protein, 160 aa, Artificial Sequence
  Description of Artificial Sequence: Synthetic polypeptide
  IL-10(N21D/Q42E/N45D/E151Q)
SPGQGTQSENSCTHFPGNLPDMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRN

SEQ ID NO: 163 - protein, 166 aa, Artificial Sequence
  Description of Artificial Sequence: Synthetic polypeptide
  IL10M1(N21D)
SPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 164 - protein, 166 aa, Artificial Sequence
  Description of Artificial Sequence: Synthetic polypeptide
  IL10M1(D28N)
SPGQGTQSENSCTHFPGNLPNMLRDLRNAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 165 - protein, 166 aa, Artificial Sequence
  Description of Artificial Sequence: Synthetic polypeptide
  IL10M1(Q38E)
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 166 - protein, 166 aa, Artificial Sequence
  Description of Artificial Sequence: Synthetic polypeptide
  IL10M1(M39T)
SPGQGTQSENSCTHFPGNLPNMLRDLRDAFSRVKTFFQTKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 167 - protein, 166 aa, Artificial Sequence
  Description of Artificial Sequence: Synthetic polypeptide
  IL10M1(D41N)
SPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 168 - protein, 166 aa, Artificial Sequence
  Description of Artificial Sequence: Synthetic polypeptide
  IL10M1(Q42E)
SPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 169 - protein, 166 aa, Artificial Sequence
  Description of Artificial Sequence: Synthetic polypeptide
  IL10M1(L43V)
SPGQGTQSENSCTHFPGNLPNMLRDLRDAFSRVKTFFQMKDQVDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 170 - protein, 166 aa, Artificial Sequence
  Description of Artificial Sequence: Synthetic polypeptide
  IL10M1(D44N)
SPGQGTQSENSCTHFPGNLPNMLRDLRDAFSRVKTFFQMKDQLNNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 171 - protein, 166 aa, Artificial Sequence
  Description of Artificial Sequence: Synthetic polypeptide
  IL10M1(N45D)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 172 - protein, 166 aa, Artificial Sequence
  Description of Artificial Sequence: Synthetic polypeptide
  IL10M1(I87A)
SPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENGGGSGGKSKAVEQVKNAFNKLQEKGIYKAMSEFDIFINYIEAYMTMKIRN

SEQ ID NO: 173 - protein, 166 aa, Artificial Sequence
  Description of Artificial Sequence: Synthetic polypeptide
  IL10M1(E142Q)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSQFDIFINYIEAYMTMKIRN

SEQ ID NO: 174 - protein, 166 aa, Artificial Sequence
  Description of Artificial Sequence: Synthetic polypeptide
  IL10M1(D144N)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFNIFINYIEAYMTMKIRN

SEQ ID NO: 175 - protein, 166 aa, Artificial Sequence
  Description of Artificial Sequence: Synthetic polypeptide
  IL10M1(E151Q)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIQAYMTMKIRN

SEQ ID NO: 176 - protein, 166 aa, Artificial Sequence
  Description of Artificial Sequence: Synthetic polypeptide
  IL10M1(Q38E/D41N)
SPGQGTQSENSCTHFPGNLPNMLRDLRDAFSRVKTFFEMKNQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 177 - protein, 166 aa, Artificial Sequence
  Description of Artificial Sequence: Synthetic polypeptide
  IL10M1(Q38E/Q42E)
SPGQGTQSENSCTHFPGNLPNMLRDLRDAFSRVKTFFEMKDELDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 178 - protein, 166 aa, Artificial Sequence
  Description of Artificial Sequence: Synthetic polypeptide
  IL10M1(Q38E/N45D)
SPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 179 - protein, 166 aa, Artificial Sequence
  Description of Artificial Sequence: Synthetic polypeptide
  IL10M1(Q38E/E142Q)
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSQFDIFINYIEAYMTMKIRN

SEQ ID NO: 180 - protein, 166 aa, Artificial Sequence
  Description of Artificial Sequence: Synthetic polypeptide
  IL10M1(Q38E/D144N)
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFNIFINYIEAYMTMKIRN

SEQ ID NO: 181 - protein, 166 aa, Artificial Sequence
  Description of Artificial Sequence: Synthetic polypeptide
  IL10M1(D41N/Q42E)
SPGQGTQSENSCTHFPGNLPNMLRDLRDAFSRVKTFFQMKNELDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 182 - protein, 166 aa, Artificial Sequence
  Description of Artificial Sequence: Synthetic polypeptide
  IL10M1(D41N/N45D)
SPGQGTQSENSCTHFPGNLPNMLRDLRDAFSRVKTFFQMKNQLDDLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 183 - protein, 166 aa, Artificial Sequence
  Description of Artificial Sequence: Synthetic polypeptide
  IL10M1(D41N/E142Q)
SPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSQFDIFINYIEAYMTMKIRN

SEQ ID NO: 184 - protein, 166 aa, Artificial Sequence
  Description of Artificial Sequence: Synthetic polypeptide
  IL10M1(D41N/D144N)
SPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFNIFINYIEAYMTMKIRN

SEQ ID NO: 185 - protein, 166 aa, Artificial Sequence
  Description of Artificial Sequence: Synthetic polypeptide
  IL10M1(Q42E/N45D)
SPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 186 - protein, 166 aa, Artificial Sequence
  Description of Artificial Sequence: Synthetic polypeptide
  IL10M1(Q42E/E142Q)
SPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSQFDIFINYIEAYMTMKIRN

SEQ ID NO: 187 - protein, 166 aa, Artificial Sequence
  Description of Artificial Sequence: Synthetic polypeptide
  IL10M1(Q42E/D144N)
SPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFNIFINYIEAYMTMKIRN

SEQ ID NO: 188 - protein, 166 aa, Artificial Sequence
  Description of Artificial Sequence: Synthetic polypeptide
  IL10M1(N45D/E142Q)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSQFDIFINYIEAYMTMKIRN

SEQ ID NO: 189 - protein, 166 aa, Artificial Sequence
  Description of Artificial Sequence: Synthetic polypeptide
  IL10M1(N45D/D144N)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFNIFINYIEAYMTMKIRN

SEQ ID NO: 190 - protein, 166 aa, Artificial Sequence
  Description of Artificial Sequence: Synthetic polypeptide
  IL10M1(E142Q/D144N)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSQFNIFINYIEAYMTMKIRN

SEQ ID NO: 191 - protein, 166 aa, Artificial Sequence
  Description of Artificial Sequence: Synthetic polypeptide
  IL10M1(N21D/Q42E)
SPGQGTQSENSCTHFPGNLPDMLRDLRDAFSRVKTFFQMKDELDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 192 - protein, 166 aa, Artificial Sequence
  Description of Artificial Sequence: Synthetic polypeptide
  IL10M1(N21D/N45D)
SPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 193 - protein, 166 aa, Artificial Sequence
  Description of Artificial Sequence: Synthetic polypeptide
  IL10M1(N21D/E151Q)
SPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIQAYMTMKIRN

SEQ ID NO: 194 - protein, 166 aa, Artificial Sequence
  Description of Artificial Sequence: Synthetic polypeptide
  IL10M1(N21D/N45E)
SPGQGTQSENSCTHFPGNLPDMLRDLRDAFSRVKTFFQMKDQLDELLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 195 - protein, 166 aa, Artificial Sequence
  Description of Artificial Sequence: Synthetic polypeptide
  IL10M1(Q42E/E151Q)
SPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIQAYMTMKIRN

SEQ ID NO: 196 - protein, 166 aa, Artificial Sequence
  Description of Artificial Sequence: Synthetic polypeptide
  IL10M1(N45D/E151Q)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIQAYMTMKIRN

SEQ ID NO: 197 - protein, 166 aa, Artificial Sequence
  Description of Artificial Sequence: Synthetic polypeptide
  IL10M1(N21D/Q42E/N45D)
SPGQGTQSENSCTHFPGNLPDMLRDLRDAFSRVKTFFQMKDELDDLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 198 - protein, 166 aa, Artificial Sequence
  Description of Artificial Sequence: Synthetic polypeptide
  IL10M1(N21D/Q42E/E151Q)
SPGQGTQSENSCTHFPGNLPDMLRDLRDAFSRVKTFFQMKDELDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIQAYMTMKIRN

SEQ ID NO: 199 - protein, 166 aa, Artificial Sequence
  Description of Artificial Sequence: Synthetic polypeptide
  IL10M1(Q42E/N45D/E151Q)
SPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIQAYMTMKIRN

SEQ ID NO: 200 - protein, 166 aa, Artificial Sequence
  Description of Artificial Sequence: Synthetic polypeptide
  IL10M1(N21D/Q42E/N45E)
SPGQGTQSENSCTHFPGNLPDMLRDLRDAFSRVKTFFQMKDELDELLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 201 - protein, 166 aa, Artificial Sequence
  Description of Artificial Sequence: Synthetic polypeptide
  IL10M1(N21D/Q42E/N45D/E151Q)
SPGQGTQSENSCTHFPGNLPDMLRDLRDAFSRVKTFFQMKDELDDLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIQAYMTMKIRN

SEQ ID NO: 202 - protein, 231 aa, Artificial Sequence; identical to SEQ ID NO: 25
  Description of Artificial Sequence: Synthetic polypeptide
  XENP25753 Chain 1 - empty_Fc(216)_IgG1_PVA_/S267K_pI(-) _Isosteric_A_L368D/K370S

SEQ ID NO: 203 - protein, 397 aa, Artificial Sequence
  Description of Artificial Sequence: Synthetic polypeptide
  XENP25753 Chain 2 - huIL10M1.14_Fc(216)_IgG1 _C220S/S364K/E357Q
SPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204 - protein, 231 aa, Artificial Sequence; identical to SEQ ID NO: 25
  Description of Artificial Sequence: Synthetic polypeptide
  XENP25754 Chain 1 - empty_Fc(216)_IgG1_PVA_/S267K_pI(-) _Isosteric_A_L368D/K370S

SEQ ID NO: 205 - protein, 397 aa, Artificial Sequence
  Description of Artificial Sequence: Synthetic polypeptide
  XENP25754 Chain 2 - huIL10M1.15_Fc(216)_IgG1 _C220S/S364K/E357Q
SPGQGTQSENSCTHFPGNLPNMLRDLRNAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - protein, 231 aa, Artificial Sequence; identical to SEQ ID NO: 25
  Description of Artificial Sequence: Synthetic polypeptide
  XENP25755 Chain 1 - empty_Fc(216)_IgG1_PVA_/S267K_pI(-) _Isosteric_A_L368D/K370S

SEQ ID NO: 207 - protein, 397 aa, Artificial Sequence
  Description of Artificial Sequence: Synthetic polypeptide
  XENP25755 Chain 2 - huIL10M1.16_Fc(216)_IgG1 _C220S/S364K/E357Q
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 208 - protein, 231 aa, Artificial Sequence; identical to SEQ ID NO: 25
  Description of Artificial Sequence: Synthetic polypeptide
  XENP25756 Chain 1 - empty_Fc(216)_IgG1_PVA_/S267K_pI(-) _Isosteric_A_L368D/K370S

SEQ ID NO: 209 - protein, 397 aa, Artificial Sequence
  Description of Artificial Sequence: Synthetic polypeptide
  XENP25756 Chain 2 - huIL10M1.17_Fc(216)_IgG1 _C220S/S364K/E357Q
SPGQGTQSENSCTHFPGNLPNMLRDLRDAFSRVKTFFQTKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 210 - protein, 231 aa, Artificial Sequence; identical to SEQ ID NO: 25
  Description of Artificial Sequence: Synthetic polypeptide
  XENP25757 Chain 1 - empty_Fc(216)_IgG1_PVA_/S267K_pI(-) _Isosteric_A_L368D/K370S

SEQ ID NO: 211 - protein, 397 aa, Artificial Sequence
  Description of Artificial Sequence: Synthetic polypeptide
  XENP25757 Chain 2 - huIL10M1.18_Fc(216)_IgG1 _C220S/S364K/E357Q
SPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 212 - protein, 231 aa, Artificial Sequence; identical to SEQ ID NO: 25
  Description of Artificial Sequence: Synthetic polypeptide
  XENP25758 Chain 1 - empty_Fc(216)_IgG1_PVA_/S267K_pI(-) _Isosteric_A_L368D/K370S

SEQ ID NO: 213 - protein, 397 aa, Artificial Sequence
  Description of Artificial Sequence: Synthetic polypeptide
  XENP25758 Chain 2 - huIL10M1.19_Fc(216)_IgG1 _C220S/S364K/E357Q
SPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 214 - protein, 231 aa, Artificial Sequence; identical to SEQ ID NO: 25
  Description of Artificial Sequence: Synthetic polypeptide
  XENP25759 Chain 1 - empty_Fc(216)_IgG1_PVA_/S267K_pI(-) _Isosteric_A_L368D/K370S

SEQ ID NO: 215 - protein, 397 aa, Artificial Sequence
  Description of Artificial Sequence: Synthetic polypeptide
  XENP25759 Chain 2 - huIL10M1.20_Fc(216)_IgG1 _C220S/S364K/E357Q
SPGQGTQSENSCTHFPGNLPNMLRDLRDAFSRVKTFFQMKDQVDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 216 - protein, 231 aa, Artificial Sequence; identical to SEQ ID NO: 25
  Description of Artificial Sequence: Synthetic polypeptide
  XENP25760 Chain 1 - empty_Fc(216)_IgG1_PVA_/S267K_pI(-) _Isosteric_A_L368D/K370S

SEQ ID NO: 217 - protein, 397 aa, Artificial Sequence
  Description of Artificial Sequence: Synthetic polypeptide
  XENP25760 Chain 2 - huIL10M1.21_Fc(216)_IgG1 _C220S/S364K/E357Q
SPGQGTQSENSCTHFPGNLPNMLRDLRDAFSRVKTFFQMKDQLNNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 218 - protein, 231 aa, Artificial Sequence; identical to SEQ ID NO: 25
  Description of Artificial Sequence: Synthetic polypeptide
  XENP25761 Chain 1 - empty_Fc(216)_IgG1_PVA_/S267K_pI(-) _Isosteric_A_L368D/K370S

SEQ ID NO: 219 - protein, 397 aa, Artificial Sequence
  Description of Artificial Sequence: Synthetic polypeptide
  XENP25761 Chain 2 - huIL10M1.22_Fc(216)_IgG1 _C220S/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 220 - protein, 231 aa, Artificial Sequence; identical to SEQ ID NO: 25
  Description of Artificial Sequence: Synthetic polypeptide
  XENP25763 Chain 1 - empty_Fc(216)_IgG1_PVA_/S267K_pI(-) _Isosteric_A_L368D/K370S

SEQ ID NO: 221 - protein, 397 aa, Artificial Sequence
  Description of Artificial Sequence: Synthetic polypeptide
  XENP25763 Chain 2 - huIL10M1.24_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENGGGSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 222 - protein, 231 aa, Artificial Sequence; identical to SEQ ID NO: 25
  Description of Artificial Sequence: Synthetic polypeptide
  XENP25766 Chain 1 - empty_Fc(216)_IgG1_PVA_/S267K_pI(-) _Isosteric_A_L368D/K370S

SEQ ID NO: 223 - protein, 397 aa, Artificial Sequence
  Description of Artificial Sequence: Synthetic polypeptide
  XENP25766 Chain 2 - huIL10M1.27_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSQFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 224 - protein, 231 aa, Artificial Sequence; identical to SEQ ID NO: 25
  Description of Artificial Sequence: Synthetic polypeptide
  XENP25767 Chain 1 - empty_Fc(216)_IgG1_PVA_/S267K_pI(-) _Isosteric_A_L368D/K370S

SEQ ID NO: 225 - protein, 397 aa, Artificial Sequence
  Description of Artificial Sequence: Synthetic polypeptide
  XENP25767 Chain 2 - huIL10M1.28_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFNIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 226 - protein, 231 aa, Artificial Sequence; identical to SEQ ID NO: 25
  Description of Artificial Sequence: Synthetic polypeptide
  XENP25768 Chain 1 - empty_Fc(216)_IgG1_PVA_/S267K_pI(-) _Isosteric_A_L368D/K370S

SEQ ID NO: 227 - protein, 397 aa, Artificial Sequence
  Description of Artificial Sequence: Synthetic polypeptide
  XENP25768 Chain 2 - huIL10M1.29_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIQAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 228 - protein, 320 aa, Artificial Sequence
  Description of Artificial Sequence: Synthetic polypeptide
  huIL10.16(Q38E/Q198E)
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 229 - protein, 320 aa, Artificial Sequence
  Description of Artificial Sequence: Synthetic polypeptide
  huIL10.18(D41N/D201N)
SPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 230 - protein, 320 aa, Artificial Sequence
  Description of Artificial Sequence: Synthetic polypeptide
  huIL10.19(Q42E/Q202E)
SPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 231 - protein, 320 aa, Artificial Sequence
  Description of Artificial Sequence: Synthetic polypeptide
  huIL10.22(N45D/N205D)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 232 - protein, 320 aa, Artificial Sequence
  Description of Artificial Sequence: Synthetic polypeptide
  huIL10.27(E142Q/E302Q)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRN

SEQ ID NO: 233 - protein, 320 aa, Artificial Sequence
  Description of Artificial Sequence: Synthetic polypeptide
  huIL10.28(D144N/D304N)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRN

SEQ ID NO: 234 - protein, 320 aa, Artificial Sequence
  Description of Artificial Sequence: Synthetic polypeptide
  huIL10.36(Q38E/D41N/Q198E/D201N)
SPGQGTQSENSCTHFPGNLPNMLRDLRDAFSRVKTFFEMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFEMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 235 - protein, 320 aa, Artificial Sequence
  Description of Artificial Sequence: Synthetic polypeptide
  huIL10.37(Q38E/Q42E/Q198E/Q202E)
SPGQGTQSENSCTHFPGNLPNMLRDLRDAFSRVKTFFEMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFEMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 236 - protein, 320 aa, Artificial Sequence
  Description of Artificial Sequence: Synthetic polypeptide
  huIL10.38(Q38E/N45D/Q198E/N205D)
SPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 237 - protein, 320 aa, Artificial Sequence
  Description of Artificial Sequence: Synthetic polypeptide
  huIL10.39(Q38E/E142Q/Q198E/E302Q)
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRNSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRN

SEQ ID NO: 238 - protein, 320 aa, Artificial Sequence
  Description of Artificial Sequence: Synthetic polypeptide
  huIL10.40(Q38E/D144N/Q198E/D304N)
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRN

SEQ ID NO: 239 - protein, 320 aa, Artificial Sequence
  Description of Artificial Sequence: Synthetic polypeptide
  huIL10.41(D41N/Q42E/D201N/Q202E)
SPGQGTQSENSCTHFPGNLPNMLRDLRDAFSRVKTFFQMKNELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKNELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 240 - protein, 320 aa, Artificial Sequence
  Description of Artificial Sequence: Synthetic polypeptide
  huIL10.42(D41N/N45D/D201N/N205D)
SPGQGTQSENSCTHFPGNLPNMLRDLRDAFSRVKTFFQMKNQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKNQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 241 - protein, 320 aa, Artificial Sequence
  Description of Artificial Sequence: Synthetic polypeptide
  huIL10.43(D41N/E142Q/D201N/E302Q)
SPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRNSPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRN

SEQ ID NO: 242 - protein, 320 aa, Artificial Sequence
  Description of Artificial Sequence: Synthetic polypeptide
  huIL10.44(D41N/D144N/D201N/D304N)
SPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNSPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRN

SEQ ID NO: 243 - protein, 320 aa, Artificial Sequence
  Description of Artificial Sequence: Synthetic polypeptide
  huIL10.45(Q42E/N45D/Q202E/N205D)
SPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 244 - protein, 320 aa, Artificial Sequence
  Description of Artificial Sequence: Synthetic polypeptide
  huIL10.46(Q42E/E142Q/Q202E/E302Q)
SPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRNSPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRN

SEQ ID NO: 245 - protein, 320 aa, Artificial Sequence
  Description of Artificial Sequence: Synthetic polypeptide
  huIL10.47(Q42E/D144N/Q202E/D304N)
SPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNSPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRN

SEQ ID NO: 246 - protein, 320 aa, Artificial Sequence
  Description of Artificial Sequence: Synthetic polypeptide
  huIL10.48(N45D/E142Q/N205D/E302Q)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRN

SEQ ID NO: 247 - protein, 320 aa, Artificial Sequence
  Description of Artificial Sequence: Synthetic polypeptide
  huIL10.49(N45D/D144N/N205D/D304N)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRN

SEQ ID NO: 248 - protein, 320 aa, Artificial Sequence
  Description of Artificial Sequence: Synthetic polypeptide
  huIL10.50(E142Q/D144N/E302Q/D304N)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFNIFINYIEAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFNIFINYIEAYMTMKIRN

SEQ ID NO: 249 - protein, 320 aa, Artificial Sequence
  Description of Artificial Sequence: Synthetic polypeptide
  huIL10.51(N21D/N181D)
SPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 250 - protein, 320 aa, Artificial Sequence
  Description of Artificial Sequence: Synthetic polypeptide
  huIL10.52(E151Q/E311Q)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRN

SEQ ID NO: 251 - protein, 320 aa, Artificial Sequence
  Description of Artificial Sequence: Synthetic polypeptide
  huIL10.53(N21D/Q42E/N181D/Q202E)
SPGQGTQSENSCTHFPGNLPDMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPDMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 252 - protein, 320 aa, Artificial Sequence
  Description of Artificial Sequence: Synthetic polypeptide
  huIL10.99(N21D/N45D/N181D/N205E)
SPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPDMLRDLRDAFSRVKTFFQMKDQLDELLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 253 - protein, 320 aa, Artificial Sequence
  Description of Artificial Sequence: Synthetic polypeptide
  huIL10.54(N21D/N45D/N181D/N205D)
SPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 254 - protein, 320 aa, Artificial Sequence
  Description of Artificial Sequence: Synthetic polypeptide
  huIL10.55(N21D/E151Q/N181D/E311Q)
SPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRNSPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRN

SEQ ID NO: 255 - protein, 320 aa, Artificial Sequence
  Description of Artificial Sequence: Synthetic polypeptide
  huIL10.56(Q42E/E151Q/E311Q)
SPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRN

SEQ ID NO: 256 - protein, 320 aa, Artificial Sequence
  Description of Artificial Sequence: Synthetic polypeptide
  huIL10.57(N45D/E151Q/N205D/E311Q)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRN

SEQ ID NO: 257 - protein, 320 aa, Artificial Sequence
  Description of Artificial Sequence: Synthetic polypeptide
  huIL10.58(N21D/Q42E/N45D/N181D/Q202E/N205E)
SPGQGTQSENSCTHFPGNLPDMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPDMLRDLRDAFSRVKTFFQMKDELDELLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 258 - protein, 320 aa, Artificial Sequence
  Description of Artificial Sequence: Synthetic polypeptide
  huIL10.59(N21D/Q42E/E151Q/N181D/Q202E/E311Q)
SPGQGTQSENSCTHFPGNLPDMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRNSPGQGTQSENSCTHFPGNLPDMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRN

SEQ ID NO: 259 - protein, 320 aa, Artificial Sequence
  Description of Artificial Sequence: Synthetic polypeptide
  huIL10.60(Q42E/N45D/E151Q/Q202E/N205D/E311Q)
SPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRNSPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRN

SEQ ID NO: 260 - protein, 320 aa, Artificial Sequence
  Description of Artificial Sequence: Synthetic polypeptide
  huIL10.61(N21D/Q42E/N45D/E151Q/N181D/Q202E/N205D/E311Q)
SPGQGTQSENSCTHFPGNLPDMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRNSPGQGTQSENSCTHFPGNLPDMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRN

SEQ ID NO: 261 - protein, 320 aa, Artificial Sequence
  Description of Artificial Sequence: Synthetic polypeptide
  huIL10.62(Q38E/N45D/N205D)
SPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 262 - protein, 320 aa, Artificial Sequence
  Description of Artificial Sequence: Synthetic polypeptide
  huIL10.63(D41N/N45D/N205D)
SPGQGTQSENSCTHFPGNLPNMLRDLRDAFSRVKTFFQMKNQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 263 - protein, 320 aa, Artificial Sequence
  Description of Artificial Sequence: Synthetic polypeptide
  huIL10.64(N45D/D144N/N205D)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 264 - protein, 320 aa, Artificial Sequence
  Description of Artificial Sequence: Synthetic polypeptide
  huIL10.65(N205D)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 265 - protein, 320 aa, Artificial Sequence
  Description of Artificial Sequence: Synthetic polypeptide
  huIL10.66(N45D)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 266 - protein, 320 aa, Artificial Sequence
  Description of Artificial Sequence: Synthetic polypeptide
  huIL10.67(N21D/N45D/N205D)
SPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 267 - protein, 320 aa, Artificial Sequence
  Description of Artificial Sequence: Synthetic polypeptide
  huIL10.68(N45D/N181D/N205D)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 268 - protein, 320 aa, Artificial Sequence
  Description of Artificial Sequence: Synthetic polypeptide
  huIL10.69(N45D/E151Q/N205D)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 269 - protein, 320 aa, Artificial Sequence
  Description of Artificial Sequence: Synthetic polypeptide
  huIL10.70(N45D/N205D/E311Q)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRN

SEQ ID NO: 270 - protein, 320 aa, Artificial Sequence
  Description of Artificial Sequence: Synthetic polypeptide
  huIL10.71(N45D/N205D/D304N)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRN

SEQ ID NO: 271 - protein, 231 aa, Artificial Sequence; identical to SEQ ID NO: 25
  Description of Artificial Sequence: Synthetic polypeptide
  XENP25978 Chain 1 - empty_Fc(216)_pI(-)_Isosteric_A_C220S/PVA _/S267K/L368D/K370S

SEQ ID NO: 272 - protein, 561 aa, Artificial Sequence
  Description of Artificial Sequence: Synthetic polypeptide
  XENP25978 Chain 2 - huIL10.16_huIL10.16_(G4S)2_IgG1_C220S/PVA _/S267K/S364K/E357Q
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 273 - protein, 231 aa, Artificial Sequence; identical to SEQ ID NO: 25
  Description of Artificial Sequence: Synthetic polypeptide
  XENP25979 Chain 1 - empty_Fc(216)_pI(-)_Isosteric_A_C220S/PVA _/S267K/L368D/K370S

SEQ ID NO: 274 - protein, 561 aa, Artificial Sequence
  Description of Artificial Sequence: Synthetic polypeptide
  XENP25979 Chain 2 - huIL10.18_huIL10.18_(G4S)2_IgG1_C220S/PVA _/S267K/S364K/E357Q
SPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 275 - protein, 231 aa, Artificial Sequence; identical to SEQ ID NO: 25
  Description of Artificial Sequence: Synthetic polypeptide
  XENP25980 Chain 1 - empty_Fc(216)_pI(-)_Isosteric_A_C220S/PVA _/S267K/L368D/K370S

SEQ ID NO: 276 - protein, 561 aa, Artificial Sequence
  Description of Artificial Sequence: Synthetic polypeptide
  XENP25980 Chain 2 - huIL10.19_huIL10.19_(G4S)2_IgG1_C220S/PVA _/S267K/S364K/E357Q
SPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 277 - protein, 231 aa, Artificial Sequence; identical to SEQ ID NO: 25
  Description of Artificial Sequence: Synthetic polypeptide
  XENP25981 Chain 1 - empty_Fc(216)_pI(-)_Isosteric_A_C220S/PVA _/S267K/L368D/K370S

SEQ ID NO: 278 - protein, 561 aa, Artificial Sequence
  Description of Artificial Sequence: Synthetic polypeptide
  XENP25981 Chain 2 - huIL10.22_huIL10.22_(G4S)2_IgG1_C220S/PVA _/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 279 - protein, 231 aa, Artificial Sequence; identical to SEQ ID NO: 25
  Description of Artificial Sequence: Synthetic polypeptide
  XENP25982 Chain 1 - empty_Fc(216)_pI(-)_Isosteric_A_C220S/PVA _/S267K/L368D/K370S

SEQ ID NO: 280 - protein, 561 aa, Artificial Sequence
  Description of Artificial Sequence: Synthetic polypeptide
  XENP25982 Chain 2 - huIL10.27_huIL10.27_(G4S)2_IgG1_C220S/PVA _/S267K/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 281 - protein, 231 aa, Artificial Sequence; identical to SEQ ID NO: 25
  Description of Artificial Sequence: Synthetic polypeptide
  XENP25983 Chain 1 - empty_Fc(216)_pI(-)_Isosteric_A_C220S/PVA _/S267K/L368D/K370S

SEQ ID NO: 282 - protein, 561 aa, Artificial Sequence
  Description of Artificial Sequence: Synthetic polypeptide
  XENP25983 Chain 2 - huIL10.28_huIL10.28_(G4S)2_IgG1_C220S/PVA _/S267K/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 283 - protein, 231 aa, Artificial Sequence; identical to SEQ ID NO: 25
  Description of Artificial Sequence: Synthetic polypeptide
  XENP25984 Chain 1 - empty_Fc(216)_pI(-)_Isosteric_A_C220S/PVA _/S267K/L368D/K370S

SEQ ID NO: 284 - protein, 561 aa, Artificial Sequence
  Description of Artificial Sequence: Synthetic polypeptide
  XENP25984 Chain 2 - huIL10.36_huIL10.36_(G4S)2_IgG1_C220S/PVA _/S267K/S364K/E357Q
SPGQGTQSENSCTHFPGNLPNMLRDLRDAFSRVKTFFEMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFEMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 285 - protein, 231 aa, Artificial Sequence; identical to SEQ ID NO: 25
  Description of Artificial Sequence: Synthetic polypeptide
  XENP25985 Chain 1 - empty_Fc(216)_pI(-)_Isosteric_A_C220S/PVA _/S267K/L368D/K370S

SEQ ID NO: 286 - protein, 561 aa, Artificial Sequence
  Description of Artificial Sequence: Synthetic polypeptide
  XENP25985 Chain 2 - huIL10.37_huIL10.37_(G4S)2_IgG1_C220S/PVA _/S267K/S364K/E357Q
SPGQGTQSENSCTHFPGNLPNMLRDLRDAFSRVKTFFEMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFEMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 287 - protein, 231 aa, Artificial Sequence; identical to SEQ ID NO: 25
  Description of Artificial Sequence: Synthetic polypeptide
  XENP25986 Chain 1 - empty_Fc(216)_pI(-)_Isosteric_A_C220S/PVA _/S267K/L368D/K370S

SEQ ID NO: 288 - protein, 561 aa, Artificial Sequence
  Description of Artificial Sequence: Synthetic polypeptide
  XENP25986 Chain 2 - huIL10.38_huIL10.38_(G4S)2_IgG1_C220S/PVA _/S267K/S364K/E357Q
SPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 289 - protein, 231 aa, Artificial Sequence; identical to SEQ ID NO: 25
  Description of Artificial Sequence: Synthetic polypeptide
  XENP25987 Chain 1 - empty_Fc(216)_pI(-)_Isosteric_A_C220S/PVA _/S267K/L368D/K370S

SEQ ID NO: 290 - protein, 561 aa, Artificial Sequence
  Description of Artificial Sequence: Synthetic polypeptide
  XENP25987 Chain 2 - huIL10.39_huIL10.39_(G4S)2_IgG1_C220S/PVA _/S267K/S364K/E357Q
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRNSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 291 - protein, 231 aa, Artificial Sequence; identical to SEQ ID NO: 25
  Description of Artificial Sequence: Synthetic polypeptide
  XENP25988 Chain 1 - empty_Fc(216)_pI(-)_Isosteric_A_C220S/PVA _/S267K/L368D/K370S

SEQ ID NO: 292 - protein, 561 aa, Artificial Sequence
  Description of Artificial Sequence: Synthetic polypeptide
  XENP25988 Chain 2 - huIL10.40_huIL10.40_(G4S)2_IgG1_C220S/PVA _/S267K/S364K/E357Q
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 293 - protein, 231 aa, Artificial Sequence; identical to SEQ ID NO: 25
  Description of Artificial Sequence: Synthetic polypeptide
  XENP25989 Chain 1 - empty_Fc(216)_pI(-)_Isosteric_A_C220S/PVA _/S267K/L368D/K370S

SEQ ID NO: 294 - protein, 561 aa, Artificial Sequence
  Description of Artificial Sequence: Synthetic polypeptide
  XENP25989 Chain 2 - huIL10.41_huIL10.41_(G4S)2_IgG1_C220S/PVA _/S267K/S364K/E357Q
SPGQGTQSENSCTHFPGNLPNMLRDLRDAFSRVKTFFQMKNELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKNELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 295 - protein, 231 aa, Artificial Sequence; identical to SEQ ID NO: 25
  Description of Artificial Sequence: Synthetic polypeptide
  XENP25990 Chain 1 - empty_Fc(216)_pI(-)_Isosteric_A_C220S/PVA _/S267K/L368D/K370S

SEQ ID NO: 296 - protein, 561 aa, Artificial Sequence
  Description of Artificial Sequence: Synthetic polypeptide
  XENP25990 Chain 2 - huIL10.42_huIL10.42_(G4S)2_IgG1_C220S/PVA _/S267K/S364K/E357Q
SPGQGTQSENSCTHFPGNLPNMLRDLRDAFSRVKTFFQMKNQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKNQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 297 - protein, 231 aa, Artificial Sequence; identical to SEQ ID NO: 25
  Description of Artificial Sequence: Synthetic polypeptide
  XENP25991 Chain 1 - empty_Fc(216)_pI(-)_Isosteric_A_C220S/PVA _/S267K/L368D/K370S

SEQ ID NO: 298 - protein, 561 aa, Artificial Sequence
  Description of Artificial Sequence: Synthetic polypeptide
  XENP25991 Chain 2 - huIL10.43_huIL10.43_(G4S)2_IgG1_C220S/PVA _/S267K/S364K/E357Q
SPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRNSPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 299 - protein, 231 aa, Artificial Sequence; identical to SEQ ID NO: 25
  Description of Artificial Sequence: Synthetic polypeptide
  XENP25992 Chain 1 - empty_Fc(216)_pI(-)_Isosteric_A_C220S/PVA _/S267K/L368D/K370S

SEQ ID NO: 300 - protein, 561 aa, Artificial Sequence
  Description of Artificial Sequence: Synthetic polypeptide
  XENP25992 Chain 2 - huIL10.44_huIL10.44_(G4S)2_IgG1_C220S/PVA _/S267K/S364K/E357Q
SPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNSPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 301 - protein, 231 aa, Artificial Sequence; identical to SEQ ID NO: 25
  Description of Artificial Sequence: Synthetic polypeptide
  XENP25993 Chain 1 - empty_Fc(216)_pI(-)_Isosteric_A_C220S/PVA _/S267K/L368D/K370S

SEQ ID NO: 302 - protein, 561 aa, Artificial Sequence
  Description of Artificial Sequence: Synthetic polypeptide
  XENP25993 Chain 2 - huIL10.45_huIL10.45_(G4S)2_C220S/PVA _/S267K/S364K/E357Q
SPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 303 - protein, 231 aa, Artificial Sequence; identical to SEQ ID NO: 25
  Description of Artificial Sequence: Synthetic polypeptide
  XENP25994 Chain 1 - empty_Fc(216)_pI(-)_Isosteric_A_C220S/PVA _/S267K/L368D/K370S

SEQ ID NO: 304 - protein, 561 aa, Artificial Sequence
  Description of Artificial Sequence: Synthetic polypeptide
  XENP25994 Chain 2 - huIL10.46_huIL10.46_(G4S)2_IgG1_C220S/PVA _/S267K/S364K/E357Q
SPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRNSPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 305 - protein, 231 aa, Artificial Sequence; identical to SEQ ID NO: 25
  Description of Artificial Sequence: Synthetic polypeptide
  XENP25995 Chain 1 - empty_Fc(216)_pI(-)_Isosteric_A_C220S/PVA _/S267K/L368D/K370S

SEQ ID NO: 306 - protein, 561 aa, Artificial Sequence
  Description of Artificial Sequence: Synthetic polypeptide
  XENP25995 Chain 2 - huIL10.47_huIL10.47_(G4S)2_IgG1_C220S/PVA _/S267K/S364K/E357Q
SPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNSPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 307 - protein, 231 aa, Artificial Sequence; identical to SEQ ID NO: 25
  Description of Artificial Sequence: Synthetic polypeptide
  XENP25996 Chain 1 - empty_Fc(216)_pI(-)_Isosteric_A_C220S/PVA _/S267K/L368D/K370S

SEQ ID NO: 308 - protein, 561 aa, Artificial Sequence
  Description of Artificial Sequence: Synthetic polypeptide
  XENP25996 Chain 2 - huIL10.48_huIL10.48_(G4S)2_IgG1_C220S/PVA _/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 309 - protein, 231 aa, Artificial Sequence; identical to SEQ ID NO: 25
  Description of Artificial Sequence: Synthetic polypeptide
  XENP26001 Chain 1 - empty_Fc(216)_pI(-)_Isosteric_A_C220S/PVA _/S267K/L368D/K370S

SEQ ID NO: 310 - protein, 561 aa, Artificial Sequence
  Description of Artificial Sequence: Synthetic polypeptide
  XENP26001 Chain 2 - huIL10.49_huIL10.49_(G4S)2_IgG1_C220S/PVA _/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 311 - protein, 231 aa, Artificial Sequence; identical to SEQ ID NO: 25
  Description of Artificial Sequence: Synthetic polypeptide
  XENP26002 Chain 1 - empty_Fc(216)_pI(-)_Isosteric_A_C220S/PVA _/S267K/L368D/K370S

SEQ ID NO: 312 - protein, 561 aa, Artificial Sequence
  Description of Artificial Sequence: Synthetic polypeptide
  XENP26002 Chain 2 - huIL10.50_huIL10.50_(G4S)2_IgG1_C220S/PVA _/S267K/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFNIFINYIEAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSQFNIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 313 - protein, 231 aa, Artificial Sequence; identical to SEQ ID NO: 25
  Description of Artificial Sequence: Synthetic polypeptide
  XENP27220 Chain 1 - empty_Fc(216)_pI(-)_Isosteric_A_C220S/PVA _/S267K/L368D/K370S

SEQ ID NO: 314 - protein, 561 aa, Artificial Sequence
  Description of Artificial Sequence: Synthetic polypeptide
  XENP27220 Chain 2 - huIL10.51_huIL10.51_(G4S)2-Fc(216)_IgG1 _C220S/PVA_/S267K/S364K/E357Q
SPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 315 - protein, 231 aa, Artificial Sequence; identical to SEQ ID NO: 25
  Description of Artificial Sequence: Synthetic polypeptide
  XENP27221 Chain 1 - empty_Fc(216)_pI(-)_Isosteric_A_C220S/PVA _/S267K/L368D/K370S

SEQ ID NO: 316 - protein, 561 aa, Artificial Sequence
  Description of Artificial Sequence: Synthetic polypeptide
  XENP27221 Chain 2 - huIL10.53_huIL10.53_(G4S)2_Fc(216)_IgG1 _C220S/PVA_/S267K/S364K/E357Q
SPGQGTQSENSCTHFPGNLPDMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPDMLRDLRDAFSRVKTFFQMKDELDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 317 - protein, 231 aa, Artificial Sequence; identical to SEQ ID NO: 25
  Description of Artificial Sequence: Synthetic polypeptide
  XENP27222 Chain 1 - empty_Fc(216)_pI(-)_Isosteric_A_C220S/PVA _/S267K/L368D/K370S

SEQ ID NO: 318 - protein, 561 aa, Artificial Sequence
  Description of Artificial Sequence: Synthetic polypeptide
  XENP27222 Chain 2 - huIL10.99_huIL10.99_(G4S)2_Fc(216)_IgG1 _C220S/PVA_/S267K/S364K/E357Q
SPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPDMLRDLRDAFSRVKTFFQMKDQLDELLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 319 - protein, 231 aa, Artificial Sequence; identical to SEQ ID NO: 25
  Description of Artificial Sequence: Synthetic polypeptide
  XENP27223 Chain 1 - empty_Fc(216)_pI(-)_Isosteric_A_C220S/PVA _/S267K/L368D/K370S

SEQ ID NO: 320 - protein, 561 aa, Artificial Sequence
  Description of Artificial Sequence: Synthetic polypeptide
  XENP27223 Chain 2 - huIL10.57_huIL10.57_(G4S)2_Fc(216)_IgG1 _C220S/PVA_/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 321 - protein, 231 aa, Artificial Sequence; identical to SEQ ID NO: 25
  Description of Artificial Sequence: Synthetic polypeptide
  XENP27224 Chain 1 - empty_Fc(216)_pI(-)_Isosteric_A_C220S/PVA _/S267K/L368D/K370S

SEQ ID NO: 322 - protein, 561 aa, Artificial Sequence
  Description of Artificial Sequence: Synthetic polypeptide
  XENP27224 Chain 2 - huIL10.58_huIL10.58_(G4S)2_Fc(216)_IgG1 _C220S/PVA_/S267K/S364K/E357Q
SPGQGTQSENSCTHFPGNLPDMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPDMLRDLRDAFSRVKTFFQMKDELDELLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 323 - protein, 231 aa, Artificial Sequence; identical to SEQ ID NO: 25
  Description of Artificial Sequence: Synthetic polypeptide
  XENP27225 Chain 1 - empty_Fc(216)_pI(-)_Isosteric_A_C220S/PVA _/S267K/L368D/K370S

SEQ ID NO: 324 - protein, 561 aa, Artificial Sequence
  Description of Artificial Sequence: Synthetic polypeptide
  XENP27225 Chain 2 - huIL10.60_huIL10.60_(G4S)2_Fc(216)_IgG1 _C220S/PVA_/S267K/S364K/E357Q
SPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRNSPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 325 - protein, 231 aa, Artificial Sequence; identical to SEQ ID NO: 25
  Description of Artificial Sequence: Synthetic polypeptide
  XENP27226 Chain 1 - empty_Fc(216)_pI(-)_Isosteric_A_C220S/PVA _/S267K/L368D/K370S

SEQ ID NO: 326 - protein, 561 aa, Artificial Sequence
  Description of Artificial Sequence: Synthetic polypeptide
  XENP27226 Chain 2 - huIL10.64_huIL10.64_(G4S)2_Fc(216)_IgG1 _C220S/PVA_/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 327 - protein, 231 aa, Artificial Sequence; identical to SEQ ID NO: 25
  Description of Artificial Sequence: Synthetic polypeptide
  XENP27987 Chain 1 - empty_Fc(216)_pI(-)_Isosteric_A_C220S/PVA _/S267K/L368D/K370S

SEQ ID NO: 328 - protein, 561 aa, Artificial Sequence
  Description of Artificial Sequence: Synthetic polypeptide
  XENP27987 Chain 2 - huIL10.65_huIL10.65_(G4S)2-Fc(216)_IgG1 _C220S/PVA_/S267K/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 329 - protein, 231 aa, Artificial Sequence; identical to SEQ ID NO: 25
  Description of Artificial Sequence: Synthetic polypeptide
  XENP27988 Chain 1 - empty_Fc(216)_pI(-)_Isosteric_A_C220S/PVA _/S267K/L368D/K370S

SEQ ID NO: 330 - protein, 561 aa, Artificial Sequence
  Description of Artificial Sequence: Synthetic polypeptide
  XENP27988 Chain 2 - huIL10.66_huIL10.66_(G4S)2_Fc(216)_IgG1 _C220S/PVA_/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 331 - protein, 231 aa, Artificial Sequence; identical to SEQ ID NO: 25
  Description of Artificial Sequence: Synthetic polypeptide
  XENP27989 Chain 1 - empty_Fc(216)_pI(-)_Isosteric_A_C220S/PVA _/S267K/L368D/K370S

SEQ ID NO: 332 - protein, 561 aa, Artificial Sequence
  Description of Artificial Sequence: Synthetic polypeptide
  XENP27989 Chain 2 - huIL10.67_huIL10.67_(G4S)2_Fc(216)_IgG1 _C220S/PVA_/S267K/S364K/E357Q
SPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 333 - protein, 231 aa, Artificial Sequence; identical to SEQ ID NO: 25
  Description of Artificial Sequence: Synthetic polypeptide
  XENP27990 Chain 1 - empty_Fc(216)_pI(-)_Isosteric_A_C220S/PVA _/S267K/L368D/K370S

SEQ ID NO: 334 - protein, 561 aa, Artificial Sequence
  Description of Artificial Sequence: Synthetic polypeptide
  XENP27990 Chain 2 - huIL10.68_huIL10.68_(G4S)2_Fc(216)_IgG1 _C220S/PVA_/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 335 - protein, 231 aa, Artificial Sequence; identical to SEQ ID NO: 25
  Description of Artificial Sequence: Synthetic polypeptide
  XENP27991 Chain 1 - empty_Fc(216)_pI(-)_Isosteric_A_C220S/PVA _/S267K/L368D/K370S

SEQ ID NO: 336 - protein, 561 aa, Artificial Sequence
  Description of Artificial Sequence: Synthetic polypeptide
  XENP27991 Chain 2 - huIL10.69_huIL10.69_(G4S)2_Fc(216)_IgG1 _C220S/PVA_/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 337 - protein, 231 aa, Artificial Sequence; identical to SEQ ID NO: 25
  Description of Artificial Sequence: Synthetic polypeptide
  XENP27992 Chain 1 - empty_Fc(216)_pI(-)_Isosteric_A_C220S/PVA _/S267K/L368D/K370S

SEQ ID NO: 338 - protein, 561 aa, Artificial Sequence
  Description of Artificial Sequence: Synthetic polypeptide
  XENP27992 Chain 2 - huIL10.70_huIL10.70_(G4S)2_Fc(216)_IgG1 _C220S/PVA_/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 339 - protein, 231 aa, Artificial Sequence; identical to SEQ ID NO: 25
  Description of Artificial Sequence: Synthetic polypeptide
  XENP27993 Chain 1 - empty_Fc(216)_pI(-)_Isosteric_A_C220S/PVA _/S267K/L368D/K370S

SEQ ID NO: 340 - protein, 561 aa, Artificial Sequence
  Description of Artificial Sequence: Synthetic polypeptide
  XENP27993 Chain 2 - huIL10.71_huIL10.71_(G4S)2_Fc(216)_IgG1 _C220S/PVA_/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 341 - protein, 231 aa, Artificial Sequence; identical to SEQ ID NO: 25
  Description of Artificial Sequence: Synthetic polypeptide
  XENP28741 Chain 1 - empty_Fc(216)_pI(-)_Isosteric_A_C220S/PVA _/S267K/L368D/K370S

SEQ ID NO: 342 - protein, 565 aa, Artificial Sequence
  Description of Artificial Sequence: Synthetic polypeptide
  XENP28741 Chain 2 - Fc(216)_IgG1_C220S/PVA _/S267K/S364K/E357Q/K447del_(G4S)3_huIL10.22_huIL10.22
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 343 - protein, 231 aa, Artificial Sequence; identical to SEQ ID NO: 25
  Description of Artificial Sequence: Synthetic polypeptide
  XENP28742 Chain 1 - empty_Fc(216)_pI(-)_Isosteric_A_C220S/PVA _/S267K/L368D/K370S

SEQ ID NO: 344 - protein, 565 aa, Artificial Sequence
  Description of Artificial Sequence: Synthetic polypeptide
  XENP28742 Chain 2 - Fc(216)_IgG1_C220S/PVA _/S267K/S364K/E357Q/K447del_(G4S)3_huIL10.45_huIL10.45
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 345 - protein, 231 aa, Artificial Sequence; identical to SEQ ID NO: 25
  Description of Artificial Sequence: Synthetic polypeptide
  XENP28743 Chain 1 - empty_Fc(216)_pI(-)_Isosteric_A_C220S/PVA _/S267K/L368D/K370S

SEQ ID NO: 346 - protein, 565 aa, Artificial Sequence
  Description of Artificial Sequence: Synthetic polypeptide
  XENP28743 Chain 2 - Fc(216)_IgG1_C220S/PVA _/S267K/S364K/E357Q/K447del_(G4S)3_huIL10.51_huIL10.51
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 347 - protein, 231 aa, Artificial Sequence; identical to SEQ ID NO: 25
  Description of Artificial Sequence: Synthetic polypeptide
  XENP28744 Chain 1 - empty_Fc(216)_pI(-)_Isosteric_A_C220S/PVA _/S267K/L368D/K370S

SEQ ID NO: 348 - protein, 565 aa, Artificial Sequence
  Description of Artificial Sequence: Synthetic polypeptide
  XENP28744 Chain 2 - Fc(216)_IgG1_C220S/PVA _/S267K/S364K/E357Q/K447del_(G4S)3_huIL10.64_huIL10.64
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 349 - protein, 231 aa, Artificial Sequence; identical to SEQ ID NO: 25
  Description of Artificial Sequence: Synthetic polypeptide
  XENP28745 Chain 1 - empty_Fc(216)_pI(-)_Isosteric_A_C220S/PVA _/S267K/L368D/K370S

SEQ ID NO: 350 - protein, 565 aa, Artificial Sequence
  Description of Artificial Sequence: Synthetic polypeptide
  XENP28745 Chain 2 - Fc(216)_IgG1_C220S/PVA _/S267K/S364K/E357Q/K447del_(G4S)3_huIL10.67_huIL10.67
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 351 - protein, 231 aa, Artificial Sequence; identical to SEQ ID NO: 25
  Description of Artificial Sequence: Synthetic polypeptide
  XENP28746 Chain 1 - empty_Fc(216)_pI(-)_Isosteric_A_C220S/PVA _/S267K/L368D/K370S

SEQ ID NO: 352 - protein, 565 aa, Artificial Sequence
  Description of Artificial Sequence: Synthetic polypeptide
  XENP28746 Chain 2 - Fc(216)_IgG1_C220S/PVA _/S267K/S364K/E357Q/K447del_(G4S)3_huIL10.68_huIL10.68
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 353 - protein, 231 aa, Artificial Sequence; identical to SEQ ID NO: 25
  Description of Artificial Sequence: Synthetic polypeptide
  XENP28747 Chain 1 - empty_Fc(216)_pI(-)_Isosteric_A_C220S/PVA _/S267K/L368D/K370S

SEQ ID NO: 354 - protein, 565 aa, Artificial Sequence
  Description of Artificial Sequence: Synthetic polypeptide
  XENP28747 Chain 2 - Fc(216)_IgG1_C220S/PVA _/S267K/S364K/E357Q/K447del_(G4S)3_huIL10.69_huIL10.69
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 355 - protein, 231 aa, Artificial Sequence; identical to SEQ ID NO: 25
  Description of Artificial Sequence: Synthetic polypeptide
  XENP28748 Chain 1 - empty_Fc(216)_pI(-)_Isosteric_A_C220S/PVA _/S267K/L368D/K370S

SEQ ID NO: 356 - protein, 565 aa, Artificial Sequence
  Description of Artificial Sequence: Synthetic polypeptide
  XENP28748 Chain 2 - Fc(216)_IgG1_C220S/PVA _/S267K/S364K/E357Q/K447del_(G4S)3_huIL10.71_huIL10.71
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFNIFINYIEAYMTMKIRN

SEQ ID NO: 357 - protein, 231 aa, Artificial Sequence; identical to SEQ ID NO: 25
  Description of Artificial Sequence: Synthetic polypeptide
  XENP28749 Chain 1 - empty_Fc(216)_pI(-)_Isosteric_A_C220S/PVA _/S267K/L368D/K370S

SEQ ID NO: 358 - protein, 565 aa, Artificial Sequence
  Description of Artificial Sequence: Synthetic polypeptide
  XENP28749 Chain 2 - Fc(216)_IgG1_C220S/PVA _/S267K/S364K/E357Q/K447del_(G4S)3_huIL10.38_huIL10.38
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 359 - protein, 231 aa, Artificial Sequence; identical to SEQ ID NO: 25
  Description of Artificial Sequence: Synthetic polypeptide
  XENP28750 Chain 1 - empty_Fc(216)_pI(-)_Isosteric_A_C220S/PVA _/S267K/L368D/K370S

SEQ ID NO: 360 - protein, 565 aa, Artificial Sequence
  Description of Artificial Sequence: Synthetic polypeptide
  XENP28750 Chain 2 - Fc(216)_IgG1_C220S/PVA _/S267K/S364K/E357Q/K447del_(G4S)3_huIL10.54_huIL10.54
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 361 - protein, 231 aa, Artificial Sequence; identical to SEQ ID NO: 25
  Description of Artificial Sequence: Synthetic polypeptide
  XENP28751 Chain 1 - empty_Fc(216)_pI(-)_Isosteric_A_C220S/PVA _/S267K/L368D/K370S

SEQ ID NO: 362 - protein, 565 aa, Artificial Sequence
  Description of Artificial Sequence: Synthetic polypeptide
  XENP28751 Chain 2 - Fc(216)_IgG1_C220S/PVA _/S267K/S364K/E357Q/K447del_(G4S)3_huIL10.57_huIL10.57
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIQAYMTMKIRN

SEQ ID NO: 363 - protein, 231 aa, Artificial Sequence; identical to SEQ ID NO: 25
  Description of Artificial Sequence: Synthetic polypeptide
  XENP28752 Chain 1 - empty_Fc(216)_pI(-)_Isosteric_A_C220S/PVA _/S267K/L368D/K370S

SEQ ID NO: 364 - protein, 565 aa, Artificial Sequence
  Description of Artificial Sequence: Synthetic polypeptide
  XENP28752 Chain 2 - Fc(216)_IgG1_C220S/PVA _/S267K/S364K/E357Q/K447del_(G4S)3_huIL10.62_huIL10.62
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 365 - protein, 231 aa, Artificial Sequence; identical to SEQ ID NO: 25
  Description of Artificial Sequence: Synthetic polypeptide
  XENP28753 Chain 1 - empty_Fc(216)_pI(-)_Isosteric_A_C220S/PVA _/S267K/L368D/K370S

SEQ ID NO: 366 - protein, 565 aa, Artificial Sequence
  Description of Artificial Sequence: Synthetic polypeptide
  XENP28753 Chain 2 - Fc(216)_IgG1_C220S/PVA _/S267K/S364K/E357Q/K447del_(G4S)3_huIL10.63_huIL10.63
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKNQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 367 - protein, 325 aa, Artificial Sequence
  Description of Artificial Sequence: Synthetic polypeptide
  scIL-10(G4S)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 368 - protein, 330 aa, Artificial Sequence
  Description of Artificial Sequence: Synthetic polypeptide
  scIL-10((G4S)2)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 369 - protein, 335 aa, Artificial Sequence
  Description of Artificial Sequence: Synthetic polypeptide
  scIL-10((G4S)3)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 370 - protein, 566 aa, Artificial Sequence; identical to SEQ ID NO: 96
  Description of Artificial Sequence: Synthetic polypeptide
  XENP25239 Chain 1 - huIL10_(G4S)_huIL10_(G4S)2_Fc(216)_IgG1 _pI(-)_Isosteric_A_C220S/PVA_/S267K/L368D/K370S

SEQ ID NO: 371 - protein, 231 aa, Artificial Sequence; identical to SEQ ID NO: 52
  Description of Artificial Sequence: Synthetic polypeptide
  XENP25239 Chain 2 - empty_Fc(216)_IgG1_C220S/PVA _/S267K/S364K/E357Q

SEQ ID NO: 372 - protein, 571 aa, Artificial Sequence; identical to SEQ ID NO: 98
  Description of Artificial Sequence: Synthetic polypeptide
  XENP25240 Chain 1 - huIL10_(G4S)2_huIL10_(G4S)2_Fc(216)_IgG1 _pI(-)_Isosteric_A_C220S/PVA_/S267K/L368D/K370S

SEQ ID NO: 373 - protein, 231 aa, Artificial Sequence; identical to SEQ ID NO: 52
  Description of Artificial Sequence: Synthetic polypeptide
  XENP25240 Chain 2 - empty_Fc(216)_IgG1_C220S/PVA _/S267K/S364K/E357Q

SEQ ID NO: 374 - protein, 576 aa, Artificial Sequence; identical to SEQ ID NO: 100
  Description of Artificial Sequence: Synthetic polypeptide
  XENP25241 Chain 1 - huIL10_(G4S)3_huIL10_(G4S)2_Fc(216)_IgG1 _pI(-)_Isosteric_A_C220S/PVA_/S267K/L368D/K370S

SEQ ID NO: 375 - protein, 231 aa, Artificial Sequence; identical to SEQ ID NO: 52
  Description of Artificial Sequence: Synthetic polypeptide
  XENP25241 Chain 2 - empty_Fc(216)_IgG1_C220S/PVA _/S267K/S364K/E357Q

SEQ ID NO: 376 - protein, 231 aa, Artificial Sequence; identical to SEQ ID NO: 25
  Description of Artificial Sequence: Synthetic polypeptide
  XENP25986 Chain 1 - empty_Fc(216)_pI(-)_Isosteric_A_C220S/PVA _/S267K/L368D/K370S

SEQ ID NO: 377 - protein, 561 aa, Artificial Sequence; identical to SEQ ID NO: 288
  Description of Artificial Sequence: Synthetic polypeptide
  XENP25986 Chain 2 - huIL10.38_huIL10.38_(G4S)2_IgG1_C220S/PVA _/S267K/S364K/E357Q

SEQ ID NO: 378 - protein, 231 aa, Artificial Sequence; identical to SEQ ID NO: 25
  Description of Artificial Sequence: Synthetic polypeptide
  XENP25993 Chain 1 - empty_Fc(216)_pI(-)_Isosteric_A_C220S/PVA _/S267K/L368D/K370S

SEQ ID NO: 379 - protein, 561 aa, Artificial Sequence; identical to SEQ ID NO: 302
  Description of Artificial Sequence: Synthetic polypeptide
  XENP25993 Chain 2 - huIL10.45_huIL10.45_(G4S)2_C220S/PVA _/S267K/S364K/E357Q

SEQ ID NO: 380 - protein, 160 aa, Artificial Sequence
  Description of Artificial Sequence: Synthetic polypeptide
  huIL10(N10A)
SPGQGTQSEASCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 381 - protein, 160 aa, Artificial Sequence
  Description of Artificial Sequence: Synthetic polypeptide
  huIL10(N10Q)
SPGQGTQSEQSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 382 - protein, 160 aa, Artificial Sequence
  Description of Artificial Sequence: Synthetic polypeptide
  huIL10(N92A)
SPGQGTQSENSCTHFPGNLPNMLRDLRDAFSRVKTFFQMKDQLDNLLLKESLLEDFKGYLGCQALSEMIQFYLEEVMPQAENQDPDIKAHVASLGENLKTLRLRLRRCLRFLPCENKSKAVEQVKNAFNKLQEKGIYKAMSEFDIFINYIEAYMTMKIRN

SEQ ID NO: 383 - protein, 160 aa, Artificial Sequence
  Description of Artificial Sequence: Synthetic polypeptide
  huIL10(N126A)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKAAFNKLQEKGIYKAMSEFDIFINYIEAYMTMKIRN

SEQ ID NO: 384 - protein, 160 aa, Artificial Sequence
  Description of Artificial Sequence: Synthetic polypeptide
  huIL10(N160A)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRA

SEQ ID NO: 385 - protein, 320 aa, Artificial Sequence
  Description of Artificial Sequence: Synthetic polypeptide
  huIL10.83(N10A/N45D/N170A/N205D)
SPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 386 - protein, 320 aa, Artificial Sequence
  Description of Artificial Sequence: Synthetic polypeptide
  huIL10.85(N45D/N92A/N205D/N252A)
SPGQGTQSENSCTHFPGNLPNMLRDLRDAFSRVKTFFQMKDQLDDLLLKESLLEDFKGYLGCQALSEMIQFYLEEVMPQAENQDPDIKAHVASLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVASLGENLKTLRLRLRRCLRFLPCENKSKAVEQVKNAFNKLQEKGIYKAMSEFDIFINYIEAYMTMKIRN

SEQ ID NO: 387 - protein, 320 aa, Artificial Sequence
  Description of Artificial Sequence: Synthetic polypeptide
  huIL10.86(N45D/N126A/N205D/N286A)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKAAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKAAFNKLQEKGIYKAMSEFDIFINYIEAYMTMKIRN

SEQ ID NO: 388 - protein, 320 aa, Artificial Sequence
  Description of Artificial Sequence: Synthetic polypeptide
  huIL10.87(N45D/N160A/N205D)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRASPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 389 - protein, 320 aa, Artificial Sequence
  Description of Artificial Sequence: Synthetic polypeptide
  huIL10.88(N45D/N205D/N320A)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRA

SEQ ID NO: 390 - protein, 320 aa, Artificial Sequence
  Description of Artificial Sequence: Synthetic polypeptide
  huIL10.89(N45D/N160A/N205D/N320A)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRASPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRA

SEQ ID NO: 391 - protein, 320 aa, Artificial Sequence
  Description of Artificial Sequence: Synthetic polypeptide
  huIL10.90(N10A/N45D/N170A/N205D/N320A)
SPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRA

SEQ ID NO: 392 - protein, 319 aa, Artificial Sequence
  Description of Artificial Sequence: Synthetic polypeptide
  huIL10.91(N10A/N45D/N170A/N205D/N320_)
SPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIR

SEQ ID NO: 393 - protein, 318 aa, Artificial Sequence
  Description of Artificial Sequence: Synthetic polypeptide
  huIL10.92(N10A/N45D/N170A/N205D/R319_/N320_)
SPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKI

SEQ ID NO: 394 - protein, 317 aa, Artificial Sequence
  Description of Artificial Sequence: Synthetic polypeptide
  huIL10.93(N10A/N45D/N170A/N205D/I318_/R319_/N320_)
SPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMK

SEQ ID NO: 395 - protein, 316 aa, Artificial Sequence
  Description of Artificial Sequence: Synthetic polypeptide
  huIL10.94(N10A/N45D/N170A/N205D/K317_/I318_/R319_/N320_)
SPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTM

SEQ ID NO: 396 - protein, 320 aa, Artificial Sequence
  Description of Artificial Sequence: Synthetic polypeptide
  huIL10.95(N10A/N45D/N205D/N320A)
SPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRA

SEQ ID NO: 397 - protein, 320 aa, Artificial Sequence
  Description of Artificial Sequence: Synthetic polypeptide
  huIL10.96(N45D/N170A/N205D/N320A)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRA

SEQ ID NO: 398 - protein, 320 aa, Artificial Sequence
  Description of Artificial Sequence: Synthetic polypeptide
  huIL10.97(N10Q/N45D/N170Q/N205D/N320A)
SPGQGTQSEQSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEQSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRA

SEQ ID NO: 399 - protein, 160 aa, Artificial Sequence
  Description of Artificial Sequence: Synthetic polypeptide
  huIL10 (D28A)
SPGQGTQSENSCTHFPGNLPNMLRDLRAAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 400 - protein, 320 aa, Artificial Sequence
  Description of Artificial Sequence: Synthetic polypeptide
  huIL10.84 (D28A/N45D/D188A/N205D)
SPGQGTQSENSCTHFPGNLPNMLRDLRAAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRAAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 401 - protein, 231 aa, Artificial Sequence; identical to SEQ ID NO: 25
  Description of Artificial Sequence: Synthetic polypeptide
  XENP28295 Chain 1 - empty_Fc(216)_IgG1_pI(-)_Isosteric_A_PVA _/S267K/L368D/K370S

SEQ ID NO: 402 - protein, 551 aa, Artificial Sequence; identical to SEQ ID NO: 105
  Description of Artificial Sequence: Synthetic polypeptide
  XENP28295 Chain 2 - huIL10_huIL10_Fc(216)_IgG1_C220S/PVA _/S267K/S364K/E357Q

SEQ ID NO: 403 - protein, 231 aa, Artificial Sequence; identical to SEQ ID NO: 25
  Description of Artificial Sequence: Synthetic polypeptide
  XENP28635 Chain 1 - empty_Fc(216)_pI(-)_Isosteric_A_C220S/PVA _/S267K/L368D/K370S

SEQ ID NO: 404 - protein, 561 aa, Artificial Sequence
  Description of Artificial Sequence: Synthetic polypeptide
  XENP28635 Chain 2 - huIL10.83_huIL10.83_(G4S)2_IgG1_C220S/PVA _/S267K/S364K/E357Q
SPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 405 - protein, 231 aa, Artificial Sequence; identical to SEQ ID NO: 25
  Description of Artificial Sequence: Synthetic polypeptide
  XENP28636 Chain 1 - empty_Fc(216)_pI(-)_Isosteric_A_C220S/PVA _/S267K/L368D/K370S

SEQ ID NO: 406 - protein, 561 aa, Artificial Sequence
  Description of Artificial Sequence: Synthetic polypeptide
  XENP28636 Chain 2 - huIL10.84_huIL10.84_(G4S)2_IgG1_C220S/PVA _/S267K/S364K/E357Q
SPGQGTQSENSCTHFPGNLPNMLRDLRAAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRAAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 407 - protein, 231 aa, Artificial Sequence; identical to SEQ ID NO: 25
  Description of Artificial Sequence: Synthetic polypeptide
  XENP28637 Chain 1 - empty_Fc(216)_pI(-)_Isosteric_A_C220S/PVA _/S267K/L368D/K370S

SEQ ID NO: 408 - protein, 561 aa, Artificial Sequence
  Description of Artificial Sequence: Synthetic polypeptide
  XENP28637 Chain 2 - huIL10.85_huIL10.85_(G4S)2_IgG1_C220S/PVA _/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVASLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVASLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 409 - protein, 231 aa, Artificial Sequence; identical to SEQ ID NO: 25
  Description of Artificial Sequence: Synthetic polypeptide
  XENP28638 Chain 1 - empty_Fc(216)_pI(-)_Isosteric_A_C220S/PVA _/S267K/L368D/K370S

SEQ ID NO: 410 - protein, 561 aa, Artificial Sequence
  Description of Artificial Sequence: Synthetic polypeptide
  XENP28638 Chain 2 - huIL10.86_huIL10.86_(G4S)2_IgG1_C220S/PVA _/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKAAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKAAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 411 - protein, 231 aa, Artificial Sequence; identical to SEQ ID NO: 25
  Description of Artificial Sequence: Synthetic polypeptide
  XENP28639 Chain 1 - empty_Fc(216)_pI(-)_Isosteric_A_C220S/PVA _/S267K/L368D/K370S

SEQ ID NO: 412 - protein, 561 aa, Artificial Sequence
  Description of Artificial Sequence: Synthetic polypeptide
  XENP28639 Chain 2 - huIL10.87_huIL10.87_(G4S)2_IgG1_C220S/PVA _/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRASPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 413 - protein, 231 aa, Artificial Sequence; identical to SEQ ID NO: 25
  Description of Artificial Sequence: Synthetic polypeptide
  XENP28640 Chain 1 - empty_Fc(216)_pI(-)_Isosteric_A_C220S/PVA _/S267K/L368D/K370S

SEQ ID NO: 414 - protein, 561 aa, Artificial Sequence
  Description of Artificial Sequence: Synthetic polypeptide
  XENP28640 Chain 2 - huIL10.88_huIL10.88_(G4S)2_IgG1_C220S/PVA _/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRAGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 415 - protein, 231 aa, Artificial Sequence; identical to SEQ ID NO: 25
  Description of Artificial Sequence: Synthetic polypeptide
  XENP28641 Chain 1 - empty_Fc(216)_pI(-)_Isosteric_A_C220S/PVA _/S267K/L368D/K370S

SEQ ID NO: 416 - protein, 561 aa, Artificial Sequence
  Description of Artificial Sequence: Synthetic polypeptide
  XENP28641 Chain 2 - huIL10.89_huIL10.89_(G4S)2_IgG1_C220S/PVA _/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRASPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRAGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 417 - protein, 231 aa, Artificial Sequence; identical to SEQ ID NO: 25
  Description of Artificial Sequence: Synthetic polypeptide
  XENP28895 Chain 1 - empty_Fc(216)_pI(-)_Isosteric_A_C220S/PVA _/S267K/L368D/K370S

SEQ ID NO: 418 - protein, 561 aa, Artificial Sequence
  Description of Artificial Sequence: Synthetic polypeptide
  XENP28895 Chain 2 - huIL10.90_huIL10.90_(G4S)2_Fc(216)_IgG1 _C220S/PVA_/S267K/S364K/E357Q
SPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRAGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 419 - protein, 231 aa, Artificial Sequence; identical to SEQ ID NO: 25
  Description of Artificial Sequence: Synthetic polypeptide
  XENP28896 Chain 1 - empty_Fc(216)_pI(-)_Isosteric_A_C220S/PVA _/S267K/L368D/K370S

SEQ ID NO: 420 - protein, 560 aa, Artificial Sequence
  Description of Artificial Sequence: Synthetic polypeptide
  XENP28896 Chain 2 - huIL10.91_huIL10.91_(G4S)2_Fc(216)_IgG1 _C220S/PVA_/S267K/S364K/E357Q
SPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 421 - protein, 231 aa, Artificial Sequence; identical to SEQ ID NO: 25
  Description of Artificial Sequence: Synthetic polypeptide
  XENP28897 Chain 1 - empty_Fc(216)_pI(-)_Isosteric_A_C220S/PVA _/S267K/L368D/K370S

SEQ ID NO: 422 - protein, 559 aa, Artificial Sequence
  Description of Artificial Sequence: Synthetic polypeptide
  XENP28897 Chain 2 - huIL10.92_huIL10.92_(G4S)2_Fc(216)_IgG1 _C220S/PVA_/S267K/S364K/E357Q
SPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 423 - protein, 231 aa, Artificial Sequence; identical to SEQ ID NO: 25
  Description of Artificial Sequence: Synthetic polypeptide
  XENP28898 Chain 1 - empty_Fc(216)_pI(-)_Isosteric_A_C220S/PVA _/S267K/L368D/K370S

SEQ ID NO: 424 - protein, 558 aa, Artificial Sequence
  Description of Artificial Sequence: Synthetic polypeptide
  XENP28898 Chain 2 - huIL10.93_huIL10.93_(G4S)2_Fc(216)_IgG1 _C220S/PVA_/S267K/S364K/E357Q
SPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 425 - protein, 231 aa, Artificial Sequence; identical to SEQ ID NO: 25
  Description of Artificial Sequence: Synthetic polypeptide
  XENP28899 Chain 1 - empty_Fc(216)_pI(-)_Isosteric_A_C220S/PVA _/S267K/L368D/K370S

SEQ ID NO: 426 - protein, 557 aa, Artificial Sequence
  Description of Artificial Sequence: Synthetic polypeptide
  XENP28899 Chain 2 - huIL10.94_huIL10.94_(G4S)2_Fc(216)_IgG1 _C220S/PVA_/S267K/S364K/E357Q
SPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 427 - protein, 231 aa, Artificial Sequence; identical to SEQ ID NO: 25
  Description of Artificial Sequence: Synthetic polypeptide
  XENP28900 Chain 1 - empty_Fc(216)_pI(-)_Isosteric_A_C220S/PVA _/S267K/L368D/K370S

SEQ ID NO: 428 - protein, 561 aa, Artificial Sequence
  Description of Artificial Sequence: Synthetic polypeptide
  XENP28900 Chain 2 - huIL10.95_huIL10.95_(G4S)2_Fc(216)_IgG1 _C220S/PVA_/S267K/S364K/E357Q
SPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRAGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 429 - protein, 231 aa, Artificial Sequence; identical to SEQ ID NO: 25
  Description of Artificial Sequence: Synthetic polypeptide
  XENP28901 Chain 1 - empty_Fc(216)_pI(-)_Isosteric_A_C220S/PVA _/S267K/L368D/K370S

SEQ ID NO: 430 - protein, 561 aa, Artificial Sequence
  Description of Artificial Sequence: Synthetic polypeptide
  XENP28901 Chain 2 - huIL10.96_huIL10.96_(G4S)2_Fc(216)_IgG1 _C220S/PVA_/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRAGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 431 - protein, 231 aa, Artificial Sequence; identical to SEQ ID NO: 25
  Description of Artificial Sequence: Synthetic polypeptide
  XENP28902 Chain 1 - empty_Fc(216)_pI(-)_Isosteric_A_C220S/PVA _/S267K/L368D/K370S

SEQ ID NO: 432 - protein, 561 aa, Artificial Sequence
  Description of Artificial Sequence: Synthetic polypeptide
  XENP28902 Chain 2 - huIL10.97_huIL10.97_(G4S)2_Fc(216)_IgG1 _C220S/PVA_/S267K/S364K/E357Q
SPGQGTQSEQSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEQSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRAGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 433 - protein, 231 aa, Artificial Sequence; identical to SEQ ID NO: 25
  Description of Artificial Sequence: Synthetic polypeptide
  XENP28904 Chain 1 - empty_Fc(216)_IgG1_pI(-)_Isosteric_A _C220S/PVA_/S267K/L368D/K370S

SEQ ID NO: 434 - protein, 551 aa, Artificial Sequence
  Description of Artificial Sequence: Synthetic polypeptide
  XENP28904 Chain 2 - huIL10.22_huIL10.22-Fc(216)_Fc(216)_IgG1 _C220S/PVA_/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 435 - protein, 231 aa, Artificial Sequence; identical to SEQ ID NO: 25
  Description of Artificial Sequence: Synthetic polypeptide
  XENP28905 Chain 1 - empty_Fc(216)_IgG1_pI(-)_Isosteric_A _C220S/PVA_/S267K/L368D/K370S

SEQ ID NO: 436 - protein, 551 aa, Artificial Sequence
  Description of Artificial Sequence: Synthetic polypeptide
  XENP28905 Chain 2 - huIL10.83_huIL10.83-Fc(216)__IgG1 _C220S/PVA_/S267K/S364K/E357Q
SPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 437 - protein, 231 aa, Artificial Sequence; identical to SEQ ID NO: 25
  Description of Artificial Sequence: Synthetic polypeptide
  XENP28906 Chain 1 - empty_Fc(216)-pI(-)_Isosteric_A_C220S/PVA _/S267K/L368D/K370S

SEQ ID NO: 438 - protein, 565 aa, Artificial Sequence
  Description of Artificial Sequence: Synthetic polypeptide
  XENP28906 Chain 2 - Fc(216)_IgG1_C220S/PVA _/S267K/S364K/E357Q/K447del_(G4S)3_huIL10.83_huIL10.83
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSEASCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 439 - protein, 160 aa, Artificial Sequence
  Description of Artificial Sequence: Synthetic polypeptide
  huIL10(N116D)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCEDKSKAVEQVKNAFNKLQEKGIYKAMSEFDIFINYIEAYMTMKIRN

SEQ ID NO: 440 - protein, 160 aa, Artificial Sequence
  Description of Artificial Sequence: Synthetic polypeptide
  huIL10(N116Q)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCEQKSKAVEQVKNAFNKLQEKGIYKAMSEFDIFINYIEAYMTMKIRN

SEQ ID NO: 441 - protein, 160 aa, Artificial Sequence
  Description of Artificial Sequence: Synthetic polypeptide
  huIL10(K117P)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENPSKAVEQVKNAFNKLQEKGIYKAMSEFDIFINYIEAYMTMKIRN

SEQ ID NO: 442 - protein, 160 aa, Artificial Sequence
  Description of Artificial Sequence: Synthetic polypeptide
  huIL10(S118A)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKAKAVEQVKNAFNKLQEKGIYKAMSEFDIFINYIEAYMTMKIRN

SEQ ID NO: 443 - protein, 320 aa, Artificial Sequence
  Description of Artificial Sequence: Synthetic polypeptide
  huIL10.74 (N45D/N116D/N205D)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCEDKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 444 - protein, 320 aa, Artificial Sequence
  Description of Artificial Sequence: Synthetic polypeptide
  huIL10.75 (N45D/N116Q/N205D)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCEQKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 445 - protein, 320 aa, Artificial Sequence
  Description of Artificial Sequence: Synthetic polypeptide
  huIL10.76 (N45D/K117P/N205D)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENPSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 446 - protein, 320 aa, Artificial Sequence
  Description of Artificial Sequence: Synthetic polypeptide
  huIL10.77 (N45D/S118A/N205D)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKAKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRN

SEQ ID NO: 447 - protein, 320 aa, Artificial Sequence
  Description of Artificial Sequence: Synthetic polypeptide
  huIL10.78 (N45D/N205D/N276D)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCEDKSKAVEQVKNAFNKLQEKGIYKAMSEFDIFINYIEAYMTMKIRN

SEQ ID NO: 448 - protein, 320 aa, Artificial Sequence
  Description of Artificial Sequence: Synthetic polypeptide
  huIL10.79 (N45D/N205D/N276Q)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCEQKSKAVEQVKNAFNKLQEKGIYKAMSEFDIFINYIEAYMTMKIRN

SEQ ID NO: 449 - protein, 320 aa, Artificial Sequence
  Description of Artificial Sequence: Synthetic polypeptide
  huIL10.80 (N45D/N205D/K277P)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENPSKAVEQVKNAFNKLQEKGIYKAMSEFDIFINYIEAYMTMKIRN

SEQ ID NO: 450 - protein, 320 aa, Artificial Sequence
  Description of Artificial Sequence: Synthetic polypeptide
  huIL10.81 (N45D/N205D/S178A)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKAKAVEQVKNAFNKLQEKGIYKAMSEFDIFINYIEAYMTMKIRN

SEQ ID NO: 451 - protein, 320 aa, Artificial Sequence
  Description of Artificial Sequence: Synthetic polypeptide
  huIL10.82 (N45D/N116D/N205D/N276D)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCEDKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCEDKSKAVEQVKNAFNKLQEKGIYKAMSEFDIFINYIEAYMTMKIRN

SEQ ID NO: 452 - protein, 231 aa, Artificial Sequence; identical to SEQ ID NO: 25
  Description of Artificial Sequence: Synthetic polypeptide
  XENP28006 Chain 1 - empty_Fc(216)_pI(-)_Isosteric_A_C220S/PVA _/S267K/L368D/K370S

SEQ ID NO: 453 - protein, 561 aa, Artificial Sequence
  Description of Artificial Sequence: Synthetic polypeptide
  XENP28006 Chain 2 - huIL10.74_huIL10.74_(G4S)2_IgG1_C220S/PVA _/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCEDKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 454 - protein, 231 aa, Artificial Sequence; identical to SEQ ID NO: 25
  Description of Artificial Sequence: Synthetic polypeptide
  XENP28007 Chain 1 - empty_Fc(216)_pI(-)_Isosteric_A_C220S/PVA _/S267K/L368D/K370S

SEQ ID NO: 455 - protein, 561 aa, Artificial Sequence
  Description of Artificial Sequence: Synthetic polypeptide
  XENP28007 Chain 2 - huIL10.75_huIL10.75_(G4S)2_IgG1_C220S/PVA _/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCEQKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 456 - protein, 231 aa, Artificial Sequence; identical to SEQ ID NO: 25
  Description of Artificial Sequence: Synthetic polypeptide
  XENP28008 Chain 1 - empty_Fc(216)_pI(-)_Isosteric_A_C220S/PVA _/S267K/L368D/K370S

SEQ ID NO: 457 - protein, 561 aa, Artificial Sequence
  Description of Artificial Sequence: Synthetic polypeptide
  XENP28008 Chain 2 - huIL10.76_huIL10.76_(G4S)2_IgG1_C220S/PVA _/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENPSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 458 - protein, 231 aa, Artificial Sequence; identical to SEQ ID NO: 25
  Description of Artificial Sequence: Synthetic polypeptide
  XENP28009 Chain 1 - empty_Fc(216)_pI(-)_Isosteric_A_C220S/PVA _/S267K/L368D/K370S

SEQ ID NO: 459 - protein, 561 aa, Artificial Sequence
  Description of Artificial Sequence: Synthetic polypeptide
  XENP28009 Chain 2 - huIL10.77_huIL10.77_(G4S)2_IgG1_C220S/PVA _/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKAKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 460 - protein, 231 aa, Artificial Sequence; identical to SEQ ID NO: 25
  Description of Artificial Sequence: Synthetic polypeptide
  XENP28010 Chain 1 - empty_Fc(216)_pI(-)_Isosteric_A_C220S/PVA _/S267K/L368D/K370S

SEQ ID NO: 461 - protein, 561 aa, Artificial Sequence
  Description of Artificial Sequence: Synthetic polypeptide
  XENP28010 Chain 2 - huIL10.78_huIL10.78_(G4S)2_IgG1_C220S/PVA _/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCEDKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 462 - protein, 231 aa, Artificial Sequence; identical to SEQ ID NO: 25
  Description of Artificial Sequence: Synthetic polypeptide
  XENP28011 Chain 1 - empty_Fc(216)_pI(-)_Isosteric_A_C220S/PVA _/S267K/L368D/K370S

SEQ ID NO: 463 - protein, 561 aa, Artificial Sequence
  Description of Artificial Sequence: Synthetic polypeptide
  XENP28011 Chain 2 - huIL10.79_huIL10.79_(G4S)2_IgG1_C220S/PVA _/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCEQKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 464 - protein, 231 aa, Artificial Sequence; identical to SEQ ID NO: 25
  Description of Artificial Sequence: Synthetic polypeptide
  XENP28012 Chain 1 - empty_Fc(216)_pI(-)_Isosteric_A_C220S/PVA _/S267K/L368D/K370S

SEQ ID NO: 465 - protein, 561 aa, Artificial Sequence
  Description of Artificial Sequence: Synthetic polypeptide
  XENP28012 Chain 2 - huIL10.80_huIL10.80_(G4S)2_IgG1_C220S/PVA _/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENPSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 466 - protein, 231 aa, Artificial Sequence; identical to SEQ ID NO: 25
  Description of Artificial Sequence: Synthetic polypeptide
  XENP28013 Chain 1 - empty_Fc(216)_pI(-)_Isosteric_A_C220S/PVA _/S267K/L368D/K370S

SEQ ID NO: 467 - protein, 561 aa, Artificial Sequence
  Description of Artificial Sequence: Synthetic polypeptide
  XENP28013 Chain 2 - huIL10.81_huIL10.81_(G4S)2_IgG1_C220S/PVA _/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCENKAKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 468 - protein, 231 aa, Artificial Sequence; identical to SEQ ID NO: 25
  Description of Artificial Sequence: Synthetic polypeptide
  XENP28014 Chain 1 - empty_Fc(216)_pI(-)_Isosteric_A_C220S/PVA _/S267K/L368D/K370S

SEQ ID NO: 469 - protein, 561 aa, Artificial Sequence
  Description of Artificial Sequence: Synthetic polypeptide
  XENP28014 Chain 2 - huIL10.82_huIL10.82_(G4S)2_IgG1_C220S/PVA _/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCEDKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCLRFLPCEDKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 470 - protein, 160 aa, Artificial Sequence
  Description of Artificial Sequence: Synthetic polypeptide
  huIL10.98(C12A/ C108A)
SPGQGTQSENSATHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRALRFLPCENKSKAVEQVKNAFNKLQEKGIYKAMSEFDIFINYIEAYMTMKIRN

SEQ ID NO: 471 - protein, 320 aa, Artificial Sequence
  Description of Artificial Sequence: Synthetic polypeptide
  huIL10.98 (C12A/N45D/C108A/C172A/N205D/C268A/N320A)
SPGQGTQSENSATHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRALRFLPCENKSKAVEQVKNAFNKLQEKGIYKAMSEFDIFINYIEAYMTMKIRNSPGQGTQSENSATHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRALRFLPCENKSKAVEQVKNAFNKLQEKGIYKAMSEFDIFINYIEAYMTMKIRA

SEQ ID NO: 472 - protein, 231 aa, Artificial Sequence; identical to SEQ ID NO: 25
  Description of Artificial Sequence: Synthetic polypeptide
  XENP28903 Chain 1 - empty_Fc(216)_pI(-)_Isosteric_A_C220S/PVA _/S267K/L368D/K370S

SEQ ID NO: 473 - protein, 561 aa, Artificial Sequence
  Description of Artificial Sequence: Synthetic polypeptide
  XENP28903 Chain 2 - huIL10.98_huIL10.98_(G4S)2_Fc(216)_IgG1 _C220S/PVA_/S267K/S364K/E357Q
SPGQGTQSENSATHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRALRFLPCENKSKAVEQVKNAFNKLQEKGIYKAMSEFDIFINYIEAYMTMKIRNSPGQGTQSENSATHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRALRFLPCENKSKAVEQVKNAFNKLQEKGIYKAMSEFDIFINYIEAYMTMKIRAGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 474 - protein, 166 aa, Artificial Sequence
  Description of Artificial Sequence: Synthetic polypeptide
  huIL10M1(C12A/C108A)
SPGQGTQSENSATHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRAHRFLPCENGGGSGGKSKAVEQVKNAFNKLQEKGIYKAMSEFDIFINYIEAYMTMKIRN

SEQ ID NO: 475 - protein, 166 aa, Artificial Sequence
  Description of Artificial Sequence: Synthetic polypeptide
  huIL10M1(F37C/M140C)
SPGQGTQSENSCTHFPGNLPNMLRDLRDAFSRVKTFCQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKACSEFDIFINYIEAYMTMKIRN

SEQ ID NO: 476 - protein, 166 aa, Artificial Sequence
  Description of Artificial Sequence: Synthetic polypeptide
  huIL10M1(Q38C/S141C)
SPGQGTQSENSCTHFPGNLPNMLRDLRDAFSRVKTFFCMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMCEFDIFINYIEAYMTMKIRN

SEQ ID NO: 477 - protein, 166 aa, Artificial Sequence
  Description of Artificial Sequence: Synthetic polypeptide
  huIL10M1(D41C/K138C)
SPGQGTQSENSCTHFPGNLPNMLRDLRDAFSRVKTFFQMKCQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYCAMSEFDIFINYIEAYMTMKIRN

SEQ ID NO: 478 - protein, 166 aa, Artificial Sequence
  Description of Artificial Sequence: Synthetic polypeptide
  huIL10M1(L47C/K138C)
SPGQGTQSENSCTHFPGNLPNMLRDLRDAFSRVKTFFQMKDQLDNLCLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYCAMSEFDIFINYIEAYMTMKIRN

SEQ ID NO: 479 - protein, 166 aa, Artificial Sequence
  Description of Artificial Sequence: Synthetic polypeptide
  huIL10M1(L48C/E142C)
SPGQGTQSENSCTHFPGNLPNMLRDLRDAFSRVKTFFQMKDQLDNLLCKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSCFDIFINYIEAYMTMKIRN

SEQ ID NO: 480 - protein, 166 aa, Artificial Sequence
  Description of Artificial Sequence: Synthetic polypeptide
  huIL10M1(S51C/A120C)
SPGQGTQSENSCTHFPGNLPNMLRDLRDAFSRVKTFFQMKDQLDNLLLKECLLEDFKGYLGCQALSEMIQFYLEEVMPQAENQDPDIKAHVNSLGENLKTLRLRLRRCHRFLPCENGGGSGGKSKCVEQVKNAFNKLQEKGIYKAMSEFDIFINYIEAYMTMKIRN

SEQ ID NO: 481 - protein, 166 aa, Artificial Sequence
  Description of Artificial Sequence: Synthetic polypeptide
  huIL10M1(D55C/A120C)
SPGQGTQSENSCTHFPGNLPNMLRDLRDAFSRVKTFFQMKDQLDNLLLKESLLECFKGYLGCQALSEMIQFYLEEVMPQAENQDPDIKAHVNSLGENLKTLRLRLRRCHRFLPCENGGGSGGKSKCVEQVKNAFNKLQEKGIYKAMSEFDIFINYIEAYMTMKIRN

SEQ ID NO: 482 - protein, 166 aa, Artificial Sequence
  Description of Artificial Sequence: Synthetic polypeptide
  huIL10M1(F56C/Y153C)
SPGQGTQSENSCTHFPGNLPNMLRDLRDAFSRVKTFFQMKDQLDNLLLKESLLEDCKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEACMTMKIRN

SEQ ID NO: 483 - protein, 166 aa, Artificial Sequence
  Description of Artificial Sequence: Synthetic polypeptide
  huIL10M1(C62A/C114A)
SPGQGTQSENSCTHFPGNLPNMLRDLRDAFSRVKTFFQMKDQLDNLLLKESLLEDFKGYLGAQALSEMIQFYLEEVMPQAENQDPDIKAHVNSLGENLKTLRLRLRRCHRFLPAENGGGSGGKSKAVEQVKNAFNKLQEKGIYKAMSEFDIFINYIEAYMTMKIRN

SEQ ID NO: 484 - protein, 166 aa, Artificial Sequence
  Description of Artificial Sequence: Synthetic polypeptide
  huIL10M1(A64C/S118C)
SPGQGTQSENSCTHFPGNLPNMLRDLRDAFSRVKTFFQMKDQLDNLLLKESLLEDFKGYLGCQCLSEMIQFYLEEVMPQAENQDPDIKAHVNSLGENLKTLRLRLRRCHRFLPCENGGGSGGKCKAVEQVKNAFNKLQEKGIYKAMSEFDIFINYIEAYMTMKIRN

SEQ ID NO: 485 - protein, 166 aa, Artificial Sequence
  Description of Artificial Sequence: Synthetic polypeptide
  huIL10M1(M68C/V121C)
SPGQGTQSENSCTHFPGNLPNMLRDLRDAFSRVKTFFQMKDQLDNLLLKESLLEDFKGYLGCQALSCMIQFYLEEVMPQAENQDPDIKAHVNSLGENLKTLRLRLRRCHRFLPCENGGGSGGKSKACEQVKNAFNKLQEKGIYKAMSEFDIFINYIEAYMTMKIRN

SEQ ID NO: 486 - protein, 166 aa, Artificial Sequence
  Description of Artificial Sequence: Synthetic polypeptide
  huIL10M1(V76C/A139C)
SPGQGTQSENSCTHFPGNLPNMLRDLRDAFSRVKTFFQMKDQLDNLLLKESLLEDFKGYLGCQALSEMIQFYLEECMPQAENQDPDIKAHVNSLGENLKTLRLRLRRCHRFLPCENGGGSGGKSKAVEQVKNAFNKLQEKGIYKCMSEFDIFINYIEAYMTMKIRN

SEQ ID NO: 487 - protein, 231 aa, Artificial Sequence; identical to SEQ ID NO: 25
  Description of Artificial Sequence: Synthetic polypeptide
  XENP25740 Chain 1 - empty_Fc(216)_IgG1_PVA_/S267K_pI(-) _Isosteric_A_L368D/K370S

SEQ ID NO: 488 - protein, 397 aa, Artificial Sequence
  Description of Artificial Sequence: Synthetic polypeptide
  XENP25740 Chain 2 - huIL10M1.1_Fc(216)_IgG1_C220S/S364K/E357Q
SPGQGTQSENSATHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRAHRFLPCENGGGSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 489 - protein, 231 aa, Artificial Sequence; identical to SEQ ID NO: 25
  Description of Artificial Sequence: Synthetic polypeptide
  XENP25741 Chain 1 - empty_Fc(216)_IgG1_PVA_/S267K_pI(-) _Isosteric_A_L368D/K370S

SEQ ID NO: 490 - protein, 397 aa, Artificial Sequence
  Description of Artificial Sequence: Synthetic polypeptide
  XENP25741 Chain 2 - huIL10M1.2_Fc(216)_IgG1_C220S/S364K/E357Q
SPGQGTQSENSCTHFPGNLPNMLRDLRDAFSRVKTFCQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKACSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 491 - protein, 231 aa, Artificial Sequence; identical to SEQ ID NO: 25
  Description of Artificial Sequence: Synthetic polypeptide
  XENP25742 Chain 1 - empty_Fc(216)_IgG1_PVA_/S267K_pI(-) _Isosteric_A_L368D/K370S

SEQ ID NO: 492 - protein, 397 aa, Artificial Sequence
  Description of Artificial Sequence: Synthetic polypeptide
  XENP25742 Chain 2 - huIL10M1.3_Fc(216)_IgG1_C220S/S364K/E357Q
SPGQGTQSENSCTHFPGNLPNMLRDLRDAFSRVKTFFCMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMCEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 493 - protein, 231 aa, Artificial Sequence; identical to SEQ ID NO: 25
  Description of Artificial Sequence: Synthetic polypeptide
  XENP25743 Chain 1 - empty_Fc(216)_IgG1_PVA_/S267K_pI(-) _Isosteric_A_L368D/K370S

SEQ ID NO: 494 - protein, 397 aa, Artificial Sequence
  Description of Artificial Sequence: Synthetic polypeptide
  XENP25743 Chain 2 - huIL10M1.4_Fc(216)_IgG1_C220S/S364K/E357Q
SPGQGTQSENSCTHFPGNLPNMLRDLRDAFSRVKTFFQMKCQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYCAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 495 - protein, 231 aa, Artificial Sequence; identical to SEQ ID NO: 25
  Description of Artificial Sequence: Synthetic polypeptide
  XENP25744 Chain 1 - empty_Fc(216)_IgG1_PVA_/S267K_pI(-) _Isosteric_A_L368D/K370S

SEQ ID NO: 496 - protein, 397 aa, Artificial Sequence
  Description of Artificial Sequence: Synthetic polypeptide
  XENP25744 Chain 2 - huIL10M1.5_Fc(216)_IgG1_C220S/S364K/E357Q
SPGQGTQSENSCTHFPGNLPNMLRDLRDAFSRVKTFFQMKDQLDNLCLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYCAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 497 - protein, 231 aa, Artificial Sequence; identical to SEQ ID NO: 25
  Description of Artificial Sequence: Synthetic polypeptide
  XENP25745 Chain 1 - empty_Fc(216)_IgG1_PVA_/S267K_pI(-) _Isosteric_A_L368D/K370S

SEQ ID NO: 498 - protein, 397 aa, Artificial Sequence
  Description of Artificial Sequence: Synthetic polypeptide
  XENP25745 Chain 2 - huIL10M1.6_Fc(216)_IgG1_C220S/S364K/E357Q
SPGQGTQSENSCTHFPGNLPNMLRDLRDAFSRVKTFFQMKDQLDNLLCKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSCFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 499 - protein, 231 aa, Artificial Sequence; identical to SEQ ID NO: 25
  Description of Artificial Sequence: Synthetic polypeptide
  XENP25746 Chain 1 - empty_Fc(216)_IgG1_PVA_/S267K_pI(-) _Isosteric_A_L368D/K370S

SEQ ID NO: 500 - protein, 397 aa, Artificial Sequence
  Description of Artificial Sequence: Synthetic polypeptide
  XENP25746 Chain 2 - huIL10M1.7_Fc(216)_IgG1_C220S/S364K/E357Q
SPGQGTQSENSCTHFPGNLPNMLRDLRDAFSRVKTFFQMKDQLDNLLLKECLLEDFKGYLGCQALSEMIQFYLEEVMPQAENQDPDIKAHVNSLGENLKTLRLRLRRCHRFLPCENGGGSGGKSKCVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 501 - protein, 231 aa, Artificial Sequence; identical to SEQ ID NO: 25
  Description of Artificial Sequence: Synthetic polypeptide
  XENP25747 Chain 1 - empty_Fc(216)_IgG1_PVA_/S267K_pI(-) _Isosteric_A_L368D/K370S

SEQ ID NO: 502 - protein, 397 aa, Artificial Sequence
  Description of Artificial Sequence: Synthetic polypeptide
  XENP25747 Chain 2 - huIL10M1.8_Fc(216)_IgG1_C220S/S364K/E357Q
SPGQGTQSENSCTHFPGNLPNMLRDLRDAFSRVKTFFQMKDQLDNLLLKESLLECFKGYLGCQALSEMIQFYLEEVMPQAENQDPDIKAHVNSLGENLKTLRLRLRRCHRFLPCENGGGSGGKSKCVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 503 - protein, 231 aa, Artificial Sequence; identical to SEQ ID NO: 25
  Description of Artificial Sequence: Synthetic polypeptide
  XENP25748 Chain 1 - empty_Fc(216)_IgG1_PVA_/S267K_pI(-) _Isosteric_A_L368D/K370S

SEQ ID NO: 504 - protein, 397 aa, Artificial Sequence
  Description of Artificial Sequence: Synthetic polypeptide
  XENP25748 Chain 2 - huIL10M1.9_Fc(216)_IgG1_C220S/S364K/E357Q
SPGQGTQSENSCTHFPGNLPNMLRDLRDAFSRVKTFFQMKDQLDNLLLKESLLEDCKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEACMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 505 - protein, 231 aa, Artificial Sequence; identical to SEQ ID NO: 25
  Description of Artificial Sequence: Synthetic polypeptide
  XENP25749 Chain 1 - empty_Fc(216)_IgG1_PVA_/S267K_pI(-) _Isosteric_A_L368D/K370S

SEQ ID NO: 506 - protein, 397 aa, Artificial Sequence
  Description of Artificial Sequence: Synthetic polypeptide
  XENP25749 Chain 2 - huIL10M1.10_Fc(216)_IgG1 _C220S/S364K/E357Q
SPGQGTQSENSCTHFPGNLPNMLRDLRDAFSRVKTFFQMKDQLDNLLLKESLLEDFKGYLGAQALSEMIQFYLEEVMPQAENQDPDIKAHVNSLGENLKTLRLRLRRCHRFLPAENGGGSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 507 - protein, 231 aa, Artificial Sequence; identical to SEQ ID NO: 25
  Description of Artificial Sequence: Synthetic polypeptide
  XENP25750 Chain 1 - empty_Fc(216)_IgG1_PVA_/S267K_pI(-) _Isosteric_A_L368D/K370S

SEQ ID NO: 508 - protein, 397 aa, Artificial Sequence
  Description of Artificial Sequence: Synthetic polypeptide
  XENP25750 Chain 2 - huIL10M1.11_Fc(216)_IgG1 _C220S/S364K/E357Q
SPGQGTQSENSCTHFPGNLPNMLRDLRDAFSRVKTFFQMKDQLDNLLLKESLLEDFKGYLGCQCLSEMIQFYLEEVMPQAENQDPDIKAHVNSLGENLKTLRLRLRRCHRFLPCENGGGSGGKCKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 509 - protein, 231 aa, Artificial Sequence; identical to SEQ ID NO: 25
  Description of Artificial Sequence: Synthetic polypeptide
  XENP25751 Chain 1 - empty_Fc(216)_IgG1_PVA_/S267K_pI(-) _Isosteric_A_L368D/K370S

SEQ ID NO: 510 - protein, 397 aa, Artificial Sequence
  Description of Artificial Sequence: Synthetic polypeptide
  XENP25751 Chain 2 - huIL10M1.12_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSCMIQFYLEEVMPQAENQDPDIKAHVNSLGENLKTLRLRLRRCHRFLPCENGGGSGGKSKACEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 511 - protein, 231 aa, Artificial Sequence; identical to SEQ ID NO: 25
  Description of Artificial Sequence: Synthetic polypeptide
  XENP25752 Chain 1 - empty_Fc(216)_IgG1_PVA_/S267K_pI(-) _Isosteric_A_L368D/K370S

SEQ ID NO: 512 - protein, 397 aa, Artificial Sequence
  Description of Artificial Sequence: Synthetic polypeptide
  XENP25752 Chain 2 - huIL10M1.13_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEECMPQAENQDPDIKAHVNSLGENLKTLRLRLRRCHRFLPCENGGGSGGKSKAVEQVKNAFNKLQEKGIYKCMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 513 - protein, 166 aa, Artificial Sequence
  Description of Artificial Sequence: Synthetic polypeptide
  huIL10M1 (L47Q)
SPGQGTQSENSCTHFPGNLPNMLRDLRDAFSRVKTFFQMKDQLDNLQLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 514 - protein, 166 aa, Artificial Sequence
  Description of Artificial Sequence: Synthetic polypeptide
  huIL10M1 (S118A)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKAKAVEQVKNAFNKLQEKGIYKAMSEFDIFINYIEAYMTMKIRN

SEQ ID NO: 515 - protein, 166 aa, Artificial Sequence
  Description of Artificial Sequence: Synthetic polypeptide
  huIL10M1 (A139Q)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKQMSEFDIFINYIEAYMTMKIRN

SEQ ID NO: 516 - protein, 231 aa, Artificial Sequence; identical to SEQ ID NO: 25
  Description of Artificial Sequence: Synthetic polypeptide
  XENP25762 Chain 1 - empty_Fc(216)_IgG1_PVA_/S267K_pI(-) _Isosteric_A_L368D/K370S

SEQ ID NO: 517 - protein, 397 aa, Artificial Sequence
  Description of Artificial Sequence: Synthetic polypeptide
  XENP25762 Chain 2 - huIL10M1.23_Fc(216)_IgG1 _C220S/S364K/E357Q
SPGQGTQSENSCTHFPGNLPNMLRDLRDAFSRVKTFFQMKDQLDNLQLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 518 - protein, 231 aa, Artificial Sequence; identical to SEQ ID NO: 25
  Description of Artificial Sequence: Synthetic polypeptide
  XENP25764 Chain 1 - empty_Fc(216)_IgG1_PVA_/S267K_pI(-) _Isosteric_A_L368D/K370S

SEQ ID NO: 519 - protein, 397 aa, Artificial Sequence
  Description of Artificial Sequence: Synthetic polypeptide
  XENP25764 Chain 2 - huIL10M1.25_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKAKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 520 - protein, 231 aa, Artificial Sequence; identical to SEQ ID NO: 25
  Description of Artificial Sequence: Synthetic polypeptide
  XENP25765 Chain 1 - empty_Fc(216)_IgG1_PVA_/S267K_pI(-) _Isosteric_A_L368D/K370S

SEQ ID NO: 521 - protein, 397 aa, Artificial Sequence
  Description of Artificial Sequence: Synthetic polypeptide
  XENP25765 Chain 2 - huIL10M1.26_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKQMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 522 - protein, 166 aa, Artificial Sequence
  Description of Artificial Sequence: Synthetic polypeptide
  huIL10M1 (WT + PGGSGG Linker)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENPGGSGGKSKAVEQVKNAFNKLQEKGIYKAMSEFDIFINYIEAYMTMKIRN

SEQ ID NO: 523 - protein, 166 aa, Artificial Sequence
  Description of Artificial Sequence: Synthetic polypeptide
  huIL10M1 (WT + GPGSGG Linker)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGPGSGGKSKAVEQVKNAFNKLQEKGIYKAMSEFDIFINYIEAYMTMKIRN

SEQ ID NO: 524 - protein, 166 aa, Artificial Sequence
  Description of Artificial Sequence: Synthetic polypeptide
  huIL10M1 (WT + GGPSGG Linker)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGPSGGKSKAVEQVKNAFNKLQEKGIYKAMSEFDIFINYIEAYMTMKIRN

SEQ ID NO: 525 - protein, 166 aa, Artificial Sequence
  Description of Artificial Sequence: Synthetic polypeptide
  huIL10M1 (WT + GGGPGG Linker)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGPGGKSKAVEQVKNAFNKLQEKGIYKAMSEFDIFINYIEAYMTMKIRN

SEQ ID NO: 526 - protein, 166 aa, Artificial Sequence
  Description of Artificial Sequence: Synthetic polypeptide
  huIL10M1 (WT + GGGSPG Linker)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSPGKSKAVEQVKNAFNKLQEKGIYKAMSEFDIFINYIEAYMTMKIRN

SEQ ID NO: 527 - protein, 166 aa, Artificial Sequence
  Description of Artificial Sequence: Synthetic polypeptide
  huIL10M1 (WT + GGGSGP Linker)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGPKSKAVEQVKNAFNKLQEKGIYKAMSEFDIFINYIEAYMTMKIRN

SEQ ID NO: 528 - protein, 165 aa, Artificial Sequence
  Description of Artificial Sequence: Synthetic polypeptide
  huIL10M1 (WT + GGGGG Linker)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGGGKSKAVEQVKNAFNKLQEKGIYKAMSEFDIFINYIEAYMTMKIRN

SEQ ID NO: 529 - protein, 164 aa, Artificial Sequence
  Description of Artificial Sequence: Synthetic polypeptide
  huIL10M1 (WT + GGGG Linker)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGGKSKAVEQVKNAFNKLQEKGIYKAMSEFDIFINYIEAYMTMKIRN

SEQ ID NO: 530 - protein, 163 aa, Artificial Sequence
  Description of Artificial Sequence: Synthetic polypeptide
  huIL10M1 (WT + GGG Linker)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGKSKAVEQVKNAFNKLQEKGIYKAMSEFDIFINYIEAYMTMKIRN

SEQ ID NO: 531 - protein, 162 aa, Artificial Sequence
  Description of Artificial Sequence: Synthetic polypeptide
  huIL10M1 (WT + GG Linker)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGKSKAVEQVKNAFNKLQEKGIYKAMSEFDIFINYIEAYMTMKIRN

SEQ ID NO: 532 - protein, 161 aa, Artificial Sequence
  Description of Artificial Sequence: Synthetic polypeptide
  huIL10M1 (WT + G Linker)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGKSKAVEQVKNAFNKLQEKGIYKAMSEFDIFINYIEAYMTMKIRN

SEQ ID NO: 533 - protein, 170 aa, Artificial Sequence
  Description of Artificial Sequence: Synthetic polypeptide
  huIL10M1 (WT + GGGGSGGGGS Linker)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGGSGGGGSKSKAVEQVKNAFNKLQEKGIYKAMSEFDIFINYIEAYMTMKIRN

SEQ ID NO: 534 - protein, 231 aa, Artificial Sequence; identical to SEQ ID NO: 25
  Description of Artificial Sequence: Synthetic polypeptide
  XENP25769 Chain 1 - empty_Fc(216)_IgG1_PVA_/S267K_pI(-) _Isosteric_A_L368D/K370S

SEQ ID NO: 535 - protein, 397 aa, Artificial Sequence
  Description of Artificial Sequence: Synthetic polypeptide
  XENP25769 Chain 2 - huIL10M1.30_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENPGGSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 536 - protein, 231 aa, Artificial Sequence; identical to SEQ ID NO: 25
  Description of Artificial Sequence: Synthetic polypeptide
  XENP25770 Chain 1 - empty_Fc(216)_IgG1_PVA_/S267K_pI(-) _Isosteric_A_L368D/K370S

SEQ ID NO: 537 - protein, 397 aa, Artificial Sequence
  Description of Artificial Sequence: Synthetic polypeptide
  XENP25770 Chain 2 - huIL10M1.31_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGPGSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 538 - protein, 231 aa, Artificial Sequence; identical to SEQ ID NO: 25
  Description of Artificial Sequence: Synthetic polypeptide
  XENP25771 Chain 1 - empty_Fc(216)_IgG1_PVA_/S267K_pI(-) _Isosteric_A_L368D/K370S

SEQ ID NO: 539 - protein, 397 aa, Artificial Sequence
  Description of Artificial Sequence: Synthetic polypeptide
  XENP25771 Chain 2 - huIL10M1.32_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGPSGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 540 - protein, 231 aa, Artificial Sequence; identical to SEQ ID NO: 25
  Description of Artificial Sequence: Synthetic polypeptide
  XENP25772 Chain 1 - empty_Fc(216)_IgG1_PVA_/S267K_pI(-) _Isosteric_A_L368D/K370S

SEQ ID NO: 541 - protein, 397 aa, Artificial Sequence
  Description of Artificial Sequence: Synthetic polypeptide
  XENP25772 Chain 2 - huIL10M1.33_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGPGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 542 - protein, 231 aa, Artificial Sequence; identical to SEQ ID NO: 25
  Description of Artificial Sequence: Synthetic polypeptide
  XENP25773 Chain 1 - empty_Fc(216)_IgG1_PVA_/S267K_pI(-) _Isosteric_A_L368D/K370S

SEQ ID NO: 543 - protein, 397 aa, Artificial Sequence
  Description of Artificial Sequence: Synthetic polypeptide
  XENP25773 Chain 2 - huIL10M1.34_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSPGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 544 - protein, 231 aa, Artificial Sequence; identical to SEQ ID NO: 25
  Description of Artificial Sequence: Synthetic polypeptide
  XENP25774 Chain 1 - empty_Fc(216)_IgG1_PVA_/S267K_pI(-) _Isosteric_A_L368D/K370S

SEQ ID NO: 545 - protein, 397 aa, Artificial Sequence
  Description of Artificial Sequence: Synthetic polypeptide
  XENP25774 Chain 2 - huIL10M1.35_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGPKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 546 - protein, 231 aa, Artificial Sequence; identical to SEQ ID NO: 25
  Description of Artificial Sequence: Synthetic polypeptide
  XENP25775 Chain 1 - empty_Fc(216)_IgG1_PVA_/S267K_pI(-) _Isosteric_A_L368D/K370S

SEQ ID NO: 547 - protein, 396 aa, Artificial Sequence
  Description of Artificial Sequence: Synthetic polypeptide
  XENP25775 Chain 2 - huIL10M1.36_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 548 - protein, 231 aa, Artificial Sequence; identical to SEQ ID NO: 25
  Description of Artificial Sequence: Synthetic polypeptide
  XENP25776 Chain 1 - empty_Fc(216)_IgG1_PVA_/S267K_pI(-) _Isosteric_A_L368D/K370S

SEQ ID NO: 549 - protein, 395 aa, Artificial Sequence
  Description of Artificial Sequence: Synthetic polypeptide
  XENP25776 Chain 2 - huIL10M1.37_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 550 - protein, 231 aa, Artificial Sequence; identical to SEQ ID NO: 25
  Description of Artificial Sequence: Synthetic polypeptide
  XENP25777 Chain 1 - empty_Fc(216)_IgG1_PVA_/S267K_pI(-) _Isosteric_A_L368D/K370S

SEQ ID NO: 551 - protein, 394 aa, Artificial Sequence
  Description of Artificial Sequence: Synthetic polypeptide
  XENP25777 Chain 2 - huIL10M1.38_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 552 - protein, 231 aa, Artificial Sequence; identical to SEQ ID NO: 25
  Description of Artificial Sequence: Synthetic polypeptide
  XENP25778 Chain 1 - empty_Fc(216)_IgG1_PVA_/S267K_pI(-) _Isosteric_A_L368D/K370S

SEQ ID NO: 553 - protein, 393 aa, Artificial Sequence
  Description of Artificial Sequence: Synthetic polypeptide
  XENP25778 Chain 2 - huIL10M1.39_Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 554 - protein, 231 aa, Artificial Sequence; identical to SEQ ID NO: 25
  Description of Artificial Sequence: Synthetic polypeptide
  XENP25779 Chain 1 - empty_Fc(216)_IgG1_PVA_/S267K_pI(-) _Isosteric_A_L368D/K370S

SEQ ID NO: 555 - protein, 392 aa, Artificial Sequence
  Description of Artificial Sequence: Synthetic polypeptide
  XENP25779 Chain 2 - huIL10M1.40_Fc(216)_IgG1_C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 556 - protein, 231 aa, Artificial Sequence; identical to SEQ ID NO: 25
  Description of Artificial Sequence: Synthetic polypeptide
  XENP25780 Chain 1 - empty_Fc(216)_IgG1_PVA_/S267K_pI(-) _Isosteric_A_L368D/K370S

SEQ ID NO: 557 - protein, 401 aa, Artificial Sequence
  Description of Artificial Sequence: Synthetic polypeptide
  XENP25780 Chain 2 - huIL10M1.41_Fc(216)_IgG1_C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGGSGGGGSKSKAVEQVKNAFNKLQEKGIYKAMSEFDIFINYIEAYMTMKIRNEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 558 - protein, 160 aa, Artificial Sequence
  Description of Artificial Sequence: Synthetic polypeptide
  huIL10(N21D-109H)
SPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 559 - protein, 160 aa, Artificial Sequence; identical to SEQ ID NO: 558
  Description of Artificial Sequence: Synthetic polypeptide
  huIL10(N21D-109H)

SEQ ID NO: 560 - protein, 160 aa, Artificial Sequence
  Description of Artificial Sequence: Synthetic polypeptide
  huIL10(D41N-109H)
SPGQGTQSENSCTHFPGNLPNMLRDLRDAFSRVKTFFQMKNQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 561 - protein, 160 aa, Artificial Sequence
  Description of Artificial Sequence: Synthetic polypeptide
  huIL10(Q42E-109H)
SPGQGTQSENSCTHFPGNLPNMLRDLRDAFSRVKTFFQMKDELDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 562 - protein, 160 aa, Artificial Sequence
  Description of Artificial Sequence: Synthetic polypeptide
  huIL10(N45D-109H)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 563 - protein, 160 aa, Artificial Sequence
  Description of Artificial Sequence: Synthetic polypeptide
  huIL10(Q38E-109H)
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 564 - protein, 160 aa, Artificial Sequence; identical to SEQ ID NO: 560
  Description of Artificial Sequence: Synthetic polypeptide
  huIL10(D41N-109H)

SEQ ID NO: 565 - protein, 160 aa, Artificial Sequence
  Description of Artificial Sequence: Synthetic polypeptide
  huIL10(D144N-109H)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFNIFINYIEAYMTMKIRN

SEQ ID NO: 566 - protein, 160 aa, Artificial Sequence
  Description of Artificial Sequence: Synthetic polypeptide
  huIL10(E151Q-109H)
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIQAYMTMKIRN

SEQ ID NO: 567 - protein, 160 aa, Artificial Sequence
  Description of Artificial Sequence: Synthetic polypeptide
  huIL10(N21D/N45D-109H)
SPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 568 - protein, 160 aa, Artificial Sequence
  Description of Artificial Sequence: Synthetic polypeptide
  huIL10(Q38E/N45D-109H)
SPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 569 - protein, 160 aa, Artificial Sequence
  Description of Artificial Sequence: Synthetic polypeptide
  huIL10(D41N/N45D-109H)
SPGQGTQSENSCTHFPGNLPNMLRDLRDAFSRVKTFFQMKNQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 570 - protein, 160 aa, Artificial Sequence
  Description of Artificial Sequence: Synthetic polypeptide
  huIL10(Q42E/N45D-109H)
SPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 571 - protein, 160 aa, Artificial Sequence
  Description of Artificial Sequence: Synthetic polypeptide
  huIL10(N45D/D144N-109H)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFNIFINYIEAYMTMKIRN

SEQ ID NO: 572 - protein, 160 aa, Artificial Sequence
  Description of Artificial Sequence: Synthetic polypeptide
  huIL10(N45D/E151Q-109H)
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIQAYMTMKIRN

SEQ ID NO: 573 - protein, 231 aa, Artificial Sequence; identical to SEQ ID NO: 25
  Description of Artificial Sequence: Synthetic polypeptide
  XENP30003 Chain 1 - empty_Fc(216)_IgG1_pI(-)_Isosteric_A _C220S/PVA_/S267K/L368D/K370S

SEQ ID NO: 574 - protein, 560 aa, Artificial Sequence
  Description of Artificial Sequence: Synthetic polypeptide
  XENP30003 Chain 2 - huIL10.100_huIL10.100_(G4S)2_IgG1 _C220S/PVA_/S267K/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 575 - protein, 231 aa, Artificial Sequence; identical to SEQ ID NO: 25
  Description of Artificial Sequence: Synthetic polypeptide
  XENP30004 Chain 1 - empty_Fc(216)_IgG1_pI(-)_Isosteric_A _C220S/PVA_/S267K/L368D/K370S

SEQ ID NO: 576 - protein, 560 aa, Artificial Sequence
  Description of Artificial Sequence: Synthetic polypeptide
  XENP30004 Chain 2 - huIL10.101_huIL10.101_(G4S)2_IgG1 _C220S/PVA_/S267K/S364K/E357Q
SPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 577 - protein, 231 aa, Artificial Sequence; identical to SEQ ID NO: 25
  Description of Artificial Sequence: Synthetic polypeptide
  XENP30006 Chain 1 - empty_Fc(216)_IgG1_pI(-)_Isosteric_A _C220S/PVA_/S267K/L368D/K370S

SEQ ID NO: 578 - protein, 560 aa, Artificial Sequence
  Description of Artificial Sequence: Synthetic polypeptide
  XENP30006 Chain 2 - huIL10.103_huIL10.103_(G4S)2_IgG1 _C220S/PVA_/S267K/S364K/E357Q
SPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 579 - protein, 231 aa, Artificial Sequence; identical to SEQ ID NO: 25
  Description of Artificial Sequence: Synthetic polypeptide
  XENP30007 Chain 1 - empty_Fc(216)_IgG1_pI(-)_Isosteric_A _C220S/PVA_/S267K/L368D/K370S

SEQ ID NO: 580 - protein, 560 aa, Artificial Sequence
  Description of Artificial Sequence: Synthetic polypeptide
  XENP30007 Chain 2 - huIL10.104_huIL10.104_(G4S)2_IgG1 _C220S/PVA_/S267K/S364K/E357Q
SPGQGTQSENSCTHFPGNLPNMLRDLRDAFSRVKTFFQMKNQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 581 - protein, 231 aa, Artificial Sequence; identical to SEQ ID NO: 25
  Description of Artificial Sequence: Synthetic polypeptide
  XENP30009 Chain 1 - empty_Fc(216)_IgG1_pI(-)_Isosteric_A _C220S/PVA_/S267K/L368D/K370S

SEQ ID NO: 582 - protein, 560 aa, Artificial Sequence
  Description of Artificial Sequence: Synthetic polypeptide
  XENP30009 Chain 2 - huIL10.106_huIL10.106_(G4S)2_IgG1 _C220S/PVA_/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIQAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 583 - protein, 231 aa, Artificial Sequence; identical to SEQ ID NO: 25
  Description of Artificial Sequence: Synthetic polypeptide
  XENP30010 Chain 1 - empty_Fc(216)_IgG1_pI(-)_Isosteric_A _C220S/PVA_/S267K/L368D/K370S

SEQ ID NO: 584 - protein, 560 aa, Artificial Sequence
  Description of Artificial Sequence: Synthetic polypeptide
  XENP30010 Chain 2 - huIL10.107_huIL10.107_(G4S)2_IgG1 _C220S/PVA_/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 585 - protein, 231 aa, Artificial Sequence; identical to SEQ ID NO: 25
  Description of Artificial Sequence: Synthetic polypeptide
  XENP30011 Chain 1 - empty_Fc(216)_IgG1_pI(-)_Isosteric_A _C220S/PVA_/S267K/L368D/K370S

SEQ ID NO: 586 - protein, 560 aa, Artificial Sequence
  Description of Artificial Sequence: Synthetic polypeptide
  XENP30011 Chain 2 - huIL10.108_huIL10.108_(G4S)2_IgG1 _C220S/PVA_/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFNIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 587 - protein, 231 aa, Artificial Sequence; identical to SEQ ID NO: 25
  Description of Artificial Sequence: Synthetic polypeptide
  XENP30012 Chain 1 - empty_Fc(216)_IgG1_pI(-)_Isosteric_A _C220S/PVA_/S267K/L368D/K370S

SEQ ID NO: 588 - protein, 560 aa, Artificial Sequence
  Description of Artificial Sequence: Synthetic polypeptide
  XENP30012 Chain 2 - huIL10.109_huIL10.109_(G4S)2_IgG1 _C220S/PVA_/S267K/S364K/E357Q
SPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 589 - protein, 231 aa, Artificial Sequence; identical to SEQ ID NO: 25
  Description of Artificial Sequence: Synthetic polypeptide
  XENP30014 Chain 1 - empty_Fc(216)_IgG1_pI(-)_Isosteric_A _C220S/PVA_/S267K/L368D/K370S

SEQ ID NO: 590 - protein, 560 aa, Artificial Sequence
  Description of Artificial Sequence: Synthetic polypeptide
  XENP30014 Chain 2 - huIL10.111_huIL10.111_(G4S)2_IgG1 _C220S/PVA_/S267K/S364K/E357Q
SPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 591 - protein, 231 aa, Artificial Sequence; identical to SEQ ID NO: 25
  Description of Artificial Sequence: Synthetic polypeptide
  XENP30015 Chain 1 - empty_Fc(216)_IgG1_pI(-)_Isosteric_A _C220S/PVA_/S267K/L368D/K370S

SEQ ID NO: 592 - protein, 560 aa, Artificial Sequence
  Description of Artificial Sequence: Synthetic polypeptide
  XENP30015 Chain 2 - huIL10.112_huIL10.112_(G4S)2_IgG1 _C220S/PVA_/S267K/S364K/E357Q
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIQAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIQAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 593 - protein, 231 aa, Artificial Sequence; identical to SEQ ID NO: 25
  Description of Artificial Sequence: Synthetic polypeptide
  XENP30016 Chain 1 - empty_Fc-IgG1_pI(-)_Isosteric_A_PVA _/S267K/L368D/K370S

SEQ ID NO: 594 - protein, 565 aa, Artificial Sequence
  Description of Artificial Sequence: Synthetic polypeptide
  XENP30016 Chain 2 - Fc(216)_IgG1_C220S/PVA _/S267K/S364K/E357Q/K447del_(G4S)3_huIL10.100_huIL10.100
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 595 - protein, 231 aa, Artificial Sequence; identical to SEQ ID NO: 25
  Description of Artificial Sequence: Synthetic polypeptide
  XENP30017 Chain 1 - empty_Fc-IgG1_pI(-)_Isosteric_A_PVA _/S267K/L368D/K370S

SEQ ID NO: 596 - protein, 565 aa, Artificial Sequence
  Description of Artificial Sequence: Synthetic polypeptide
  XENP30017 Chain 2 - Fc(216)_IgG1_C220S/PVA _/S267K/S364K/E357Q/K447del_(G4S)3_huIL10.101_huIL10.101
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPDMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 597 - protein, 231 aa, Artificial Sequence; identical to SEQ ID NO: 25
  Description of Artificial Sequence: Synthetic polypeptide
  XENP30018 Chain 1 - empty_Fc-IgG1_pI(-)_Isosteric_A_PVA _/S267K/L368D/K370S

SEQ ID NO: 598 - protein, 565 aa, Artificial Sequence
  Description of Artificial Sequence: Synthetic polypeptide
  XENP30018 Chain 2 - Fc(216)_IgG1_C220S/PVA _/S267K/S364K/E357Q/K447del_(G4S)3_huIL10.102_huIL10.102
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 599 - protein, 231 aa, Artificial Sequence; identical to SEQ ID NO: 25
  Description of Artificial Sequence: Synthetic polypeptide
  XENP30019 Chain 1 - empty_Fc-IgG1_pI(-)_Isosteric_A_PVA _/S267K/L368D/K370S

SEQ ID NO: 600 - protein, 565 aa, Artificial Sequence
  Description of Artificial Sequence: Synthetic polypeptide
  XENP30019 Chain 2 - Fc(216)_IgG1_C220S/PVA _/S267K/S364K/E357Q/K447del_(G4S)3_huIL10.103_huIL10.103
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 601 - protein, 231 aa, Artificial Sequence; identical to SEQ ID NO: 25
  Description of Artificial Sequence: Synthetic polypeptide
  XENP30020 Chain 1 - empty_Fc-IgG1_pI(-)_Isosteric_A_PVA _/S267K/L368D/K370S

SEQ ID NO: 602 - protein, 565 aa, Artificial Sequence
  Description of Artificial Sequence: Synthetic polypeptide
  XENP30020 Chain 2 - Fc(216)_IgG1_C220S/PVA _/S267K/S364K/E357Q/K447del_(G4S)3_huIL10.104_huIL10.104
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKNQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 603 - protein, 231 aa, Artificial Sequence; identical to SEQ ID NO: 25
  Description of Artificial Sequence: Synthetic polypeptide
  XENP30021 Chain 1 - empty_Fc-IgG1_pI(-)_Isosteric_A_PVA _/S267K/L368D/K370S

SEQ ID NO: 604 - protein, 565 aa, Artificial Sequence
  Description of Artificial Sequence: Synthetic polypeptide
  XENP30021 Chain 2 - Fc(216)_IgG1_C220S/PVA _/S267K/S364K/E357Q/K447del_(G4S)3_huIL10.105_huIL10.105
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFNIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 605 - protein, 231 aa, Artificial Sequence; identical to SEQ ID NO: 25
  Description of Artificial Sequence: Synthetic polypeptide
  XENP30022 Chain 1 - empty_Fc-IgG1_pI(-)_Isosteric_A_PVA _/S267K/L368D/K370S

SEQ ID NO: 606 - protein, 565 aa, Artificial Sequence
  Description of Artificial Sequence: Synthetic polypeptide
  XENP30022 Chain 2 - Fc(216)_IgG1_C220S/PVA _/S267K/S364K/E357Q/K447del_(G4S)3_huIL10.106_huIL10.106
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIQAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 607 - protein, 231 aa, Artificial Sequence; identical to SEQ ID NO: 25
  Description of Artificial Sequence: Synthetic polypeptide
  XENP30023 Chain 1 - empty_Fc-IgG1_pI(-)_Isosteric_A_PVA _/S267K/L368D/K370S

SEQ ID NO: 608 - protein, 565 aa, Artificial Sequence
  Description of Artificial Sequence: Synthetic polypeptide
  XENP30023 Chain 2 - Fc(216)_IgG1_C220S/PVA _/S267K/S364K/E357Q/K447del_(G4S)3_huIL10.107_huIL10.107
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 609 - protein, 231 aa, Artificial Sequence; identical to SEQ ID NO: 25
  Description of Artificial Sequence: Synthetic polypeptide
  XENP30024 Chain 1 - empty_Fc-IgG1_pI(-)_Isosteric_A_PVA _/S267K/L368D/K370S

SEQ ID NO: 610 - protein, 565 aa, Artificial Sequence
  Description of Artificial Sequence: Synthetic polypeptide
  XENP30024 Chain 2 - Fc(216)_IgG1_C220S/PVA _/S267K/S364K/E357Q/K447del_(G4S)3_huIL10.108_huIL10.108
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFNIFINYIEAYMTMKIRN

SEQ ID NO: 611 - protein, 231 aa, Artificial Sequence; identical to SEQ ID NO: 25
  Description of Artificial Sequence: Synthetic polypeptide
  XENP30025 Chain 1 - empty_Fc-IgG1_pI(-)_Isosteric_A_PVA _/S267K/L368D/K370S

SEQ ID NO: 612 - protein, 565 aa, Artificial Sequence
  Description of Artificial Sequence: Synthetic polypeptide
  XENP30025 Chain 2 - Fc(216)_IgG1_C220S/PVA _/S267K/S364K/E357Q/K447del_(G4S)3_huIL10.109_huIL10.109
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPDMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 613 - protein, 231 aa, Artificial Sequence; identical to SEQ ID NO: 25
  Description of Artificial Sequence: Synthetic polypeptide
  XENP30026 Chain 1 - empty_Fc-IgG1_pI(-)_Isosteric_A_PVA _/S267K/L368D/K370S

SEQ ID NO: 614 - protein, 565 aa, Artificial Sequence
  Description of Artificial Sequence: Synthetic polypeptide
  XENP30026 Chain 2 - Fc(216)_IgG1_C220S/PVA _/S267K/S364K/E357Q/K447del_(G4S)3_huIL10.110_huIL10.110
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 615 - protein, 231 aa, Artificial Sequence; identical to SEQ ID NO: 25
  Description of Artificial Sequence: Synthetic polypeptide
  XENP30027 Chain 1 - empty_Fc-IgG1_pI(-)_Isosteric_A_PVA _/S267K/L368D/K370S

SEQ ID NO: 616 - protein, 565 aa, Artificial Sequence
  Description of Artificial Sequence: Synthetic polypeptide
  XENP30027 Chain 2 - Fc(216)_IgG1_C220S/PVA _/S267K/S364K/E357Q/K447del_(G4S)3_huIL10.111_huIL10.111
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFQMKDELDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 617 - protein, 231 aa, Artificial Sequence; identical to SEQ ID NO: 25
  Description of Artificial Sequence: Synthetic polypeptide
  XENP30028 Chain 1 - empty_Fc-IgG1_pI(-)_Isosteric_A_PVA _/S267K/L368D/K370S

SEQ ID NO: 618 - protein, 565 aa, Artificial Sequence
  Description of Artificial Sequence: Synthetic polypeptide
  XENP30028 Chain 2 - Fc(216)_IgG1_C220S/PVA _/S267K/S364K/E357Q/K447del_(G4S)3_huIL10.112_huIL10.112
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIQAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIQAYMTMKIRN

SEQ ID NO: 619 - protein, 231 aa, Artificial Sequence; identical to SEQ ID NO: 73
  Description of Artificial Sequence: Synthetic polypeptide
  XENP31091 Chain 1 - empty_Fc(216)_IgG1_pI(-)_Isosteric_A _C220S/PVA_/S267K/L368D/K370S/M428L/N434S

SEQ ID NO: 620 - protein, 560 aa, Artificial Sequence
  Description of Artificial Sequence: Synthetic polypeptide
  XENP31091 Chain 2 - huIL10.102_huIL10.102_(G4S)2_IgG1 _C220S/PVA_/S267K/S364K/E357Q/M428L/N434S
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 621 - protein, 231 aa, Artificial Sequence; identical to SEQ ID NO: 73
  Description of Artificial Sequence: Synthetic polypeptide
  XENP31092 Chain 1 - empty_Fc(216)_IgG1_pI(-)_Isosteric_A _C220S/PVA_/S267K/L368D/K370S/M428L/N434S

SEQ ID NO: 622 - protein, 560 aa, Artificial Sequence
  Description of Artificial Sequence: Synthetic polypeptide
  XENP31092 Chain 2 - huIL10.105_huIL10.105_(G4S)2_IgG1 _C220S/PVA_/S267K/S364K/E357Q/M428L/N434S
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFNIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 623 - protein, 231 aa, Artificial Sequence; identical to SEQ ID NO: 73
  Description of Artificial Sequence: Synthetic polypeptide
  XENP31093 Chain 1 - empty_Fc(216)_IgG1_pI(-)_Isosteric_A _C220S/PVA_/S267K/L368D/K370S/M428L/N434S

SEQ ID NO: 624 - protein, 560 aa, Artificial Sequence
  Description of Artificial Sequence: Synthetic polypeptide
  XENP31093 Chain 2 - huIL10.110_huIL10.110_(G4S)2_IgG1 _C220S/PVA_/S267K/S364K/E357Q/M428L/N434S
SPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 625 - protein, 229 aa, Artificial Sequence
  Description of Artificial Sequence: Synthetic polypeptide
  XENP31094 Chain 1 - empty_Fc(216)_IgG1_pI(-)_Isosteric_A _C220S/PVA_/S267K/L368D/K370S/M428L/N434S/G446del/K447del
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSP

SEQ ID NO: 626 - protein, 558 aa, Artificial Sequence
  Description of Artificial Sequence: Synthetic polypeptide
  XENP31094 Chain 2 - huIL10.102_huIL10.102_(G4S)2_IgG1 _C220S/PVA_/S267K/S364K/E357Q/M428L/N434S/G446del/K447del
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSP

SEQ ID NO: 627 - protein, 229 aa, Artificial Sequence; identical to SEQ ID NO: 625
  Description of Artificial Sequence: Synthetic polypeptide
  XENP31095 Chain 1 - empty_Fc(216)_IgG1_pI(-)_Isosteric_A _C220S/PVA_/S267K/L368D/K370S/M428L/N434S/G446del/K447del

SEQ ID NO: 628 - protein, 558 aa, Artificial Sequence
  Description of Artificial Sequence: Synthetic polypeptide
  XENP31095 Chain 2 - huIL10.105_huIL10.105_(G4S)2_IgG1 _C220S/PVA_/S267K/S364K/E357Q/M428L/N434S/G446del/K447del
SPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFNIFINYIEAYMTMKIRNSPGQGTQSENSCTHFPGNLPNMLRDLRDAFSRVKTFFQMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSP

SEQ ID NO: 629 - protein, 229 aa, Artificial Sequence; identical to SEQ ID NO: 625
  Description of Artificial Sequence: Synthetic polypeptide
  XENP31096 Chain 1 - empty_Fc(216)_IgG1_pI(-)_Isosteric_A _C220S/PVA_/S267K/L368D/K370S/M428L/N434S/G446del/K447del

SEQ ID NO: 630 - protein, 558 aa, Artificial Sequence
  Description of Artificial Sequence: Synthetic polypeptide
  XENP31096 Chain 2 - huIL10.110_huIL10.110_(G4S)2_IgG1 _C220S/PVA_/S267K/S364K/E357Q/M428L/N434S/G446del/K447del
SPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFEMKDQLDDLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSP

SEQ ID NO: 631 - protein, 231 aa, Artificial Sequence; identical to SEQ ID NO: 73
  Description of Artificial Sequence: Synthetic polypeptide
  XENP31830 Chain 1 - empty_Fc(216)_IgG1_pI(-)_Isosteric_A _C220S/PVA_/S267K/L368D/K370S/M428L/N434S

SEQ ID NO: 632 - protein, 560 aa, Artificial Sequence
  Description of Artificial Sequence: Synthetic polypeptide
  XENP31830 Chain 2 - huIL10.100_huIL10.100_(G4S)2_IgG1 _C220S/PVA_/S267K/S364K/E357Q/M428L/N434S
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 633 - protein, 229 aa, Artificial Sequence; identical to SEQ ID NO: 625
  Description of Artificial Sequence: Synthetic polypeptide
  XENP31831 Chain 1 - empty_Fc(216)_IgG1_pI(-)_Isosteric_A _C220S/PVA_/S267K/L368D/K370S/M428L/N434S/G446del/K447del

SEQ ID NO: 634 - protein, 558 aa, Artificial Sequence
  Description of Artificial Sequence: Synthetic polypeptide
  XENP31831 Chain 2 - huIL10.100_huIL10.100_(G4S)2_IgG1 _C220S/PVA_/S267K/S364K/E357Q/M428L/N434S/G446del/K447del
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSP

SEQ ID NO: 635 - protein, 449 aa, Artificial Sequence
  Description of Artificial Sequence: Synthetic polypeptide
  XENP31273 Chain 1 - Numax_VH_IgG1_pI(-)_Isosteric_A_PVA _/S267K/L368D/K370S
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 636 - protein, 560 aa, Artificial Sequence; identical to SEQ ID NO: 26
  Description of Artificial Sequence: Synthetic polypeptide
  XENP31273 Chain 2 - huIL10.102_huIL10.102_(G4S)2_IgG1 _C220S/PVA_/S267K/S364K/E357Q

SEQ ID NO: 637 - protein, 213 aa, Artificial Sequence
  Description of Artificial Sequence: Synthetic polypeptide
  XENP31273 Chain 3 - Numax_LC
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 638 - protein, 449 aa, Artificial Sequence; identical to SEQ ID NO: 635
  Description of Artificial Sequence: Synthetic polypeptide
  XENP31274 Chain 1 - Numax_VH_IgG1_pI(-)_Isosteric_A_PVA _/S267K/L368D/K370S

SEQ ID NO: 639 - protein, 560 aa, Artificial Sequence; identical to SEQ ID NO: 28
  Description of Artificial Sequence: Synthetic polypeptide
  XENP31274 Chain 2 - huIL10.105_huIL10.105_(G4S)2_IgG1 _C220S/PVA_/S267K/S364K/E357Q

SEQ ID NO: 640 - protein, 213 aa, Artificial Sequence; identical to SEQ ID NO: 637
  Description of Artificial Sequence: Synthetic polypeptide
  XENP31274 Chain 3 - Numax_LC

SEQ ID NO: 641 - protein, 449 aa, Artificial Sequence; identical to SEQ ID NO: 635
  Description of Artificial Sequence: Synthetic polypeptide
  XENP31275 Chain 1 - Numax_VH_pI(-)_Isosteric_A_PVA _/S267K/L368D/K370S

SEQ ID NO: 642 - protein, 565 aa, Artificial Sequence; identical to SEQ ID NO: 598
  Description of Artificial Sequence: Synthetic polypeptide
  XENP31275 Chain 2 - empty_Fc_Fc(216)_IgG1_C220S/PVA _/S267K/S364K/E357Q/K447del_(G4S)3_huIL10.102_huIL10.102

SEQ ID NO: 643 - protein, 213 aa, Artificial Sequence; identical to SEQ ID NO: 637
  Description of Artificial Sequence: Synthetic polypeptide
  XENP31275 Chain 3 - Numax_LC

SEQ ID NO: 644 - protein, 449 aa, Artificial Sequence; identical to SEQ ID NO: 635
  Description of Artificial Sequence: Synthetic polypeptide
  XENP31276 Chain 1 - Numax_VH_pI(-)_Isosteric_A_PVA _/S267K/L368D/K370S

SEQ ID NO: 645 - protein, 565 aa, Artificial Sequence; identical to SEQ ID NO: 604
  Description of Artificial Sequence: Synthetic polypeptide
  XENP31276 Chain 2 - empty_Fc_Fc(216)_IgG1_C220S/PVA _/S267K/S364K/E357Q/K447del_(G4S)3_huIL10.105_huIL10.105

SEQ ID NO: 646 - protein, 213 aa, Artificial Sequence; identical to SEQ ID NO: 637
  Description of Artificial Sequence: Synthetic polypeptide
  XENP31276 Chain 3 - Numax_LC

SEQ ID NO: 647 - protein, 118 aa, Artificial Sequence
  Description of Artificial Sequence: Synthetic polypeptide
  OKT8_H2 Variable Heavy Domain
QVQLVQSGAEVKKPGASVKVSCKASGFNIKDTYIHWVRQAPGKGLEWMGRIDPANDNTLYASKFQGRVTITADTSINTAYMELSRLRSDDTAVYYCGRGYGYYVFDHWGQGTTVTVSS

SEQ ID NO: 648 - protein, 107 aa, Artificial Sequence
  Description of Artificial Sequence: Synthetic polypeptide
  OKT8_L1 Variable Light Domain
DIKMTQSPSSLSASVGDRVTITCRTSRSISQYLAWYQEKPGKTNKLLIYSGSTLQSGIPSRFSGSGSGTDFTLTISSLQPEDFATYYCQQHNENPLTFGAGTKLEIK

SEQ ID NO: 649 - protein, 121 aa, Artificial Sequence
  Description of Artificial Sequence: Synthetic polypeptide
  1C11B3[CD8]_H1 Variable Heavy Domain
EVQLLESGGGLVQPGGSLRLSCAASGFTFGSYAMSWVRQAPGKGLEWVSTITASGGTTFYADSVKGRFTISRDNSKNTLYLQMNSLRAEDTAVYYCAKDADGYGAIAFDYWGQGTLVTVSS

SEQ ID NO: 650 - protein, 107 aa, Artificial Sequence
  Description of Artificial Sequence: Synthetic polypeptide
  1C11B3[CD8]_L1 Variable Light Domain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 651 - protein, 115 aa, Artificial Sequence
  Description of Artificial Sequence: Synthetic polypeptide
  MS[NKG2D] H0 Variable Heavy Domain
QVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSS

SEQ ID NO: 652 - protein, 108 aa, Artificial Sequence
  Description of Artificial Sequence: Synthetic polypeptide
  MS[NKG2D] L0 Variable Light Domain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 653 - protein, 121 aa, Artificial Sequence
  Description of Artificial Sequence: Synthetic polypeptide
  1D7B4[NKG2D]_H1 Variable Heavy
EVQLLESGGGLVQPGGSLRLSCAASGFTFSSYAMSWVRQAPGKGLEWVSSISASGGSTYYADSVKGRFTISRDNSKNTLYLQMNSLRAEDTAVYYCAKGIFSIYFFYFDYWGQGTLVTVSS

SEQ ID NO: 654 - protein, 107 aa, Artificial Sequence; identical to SEQ ID NO: 650
  Description of Artificial Sequence: Synthetic polypeptide
  1D7B4[NKG2D]_L1 Variable Light

SEQ ID NO: 655 - protein, 118 aa, Artificial Sequence
  Description of Artificial Sequence: Synthetic polypeptide
  KYK-1.0[NKG2D]_H1 Variable Heavy
EVQLVESGGGVVQPGGSLRLSCAASGFTFSSYGMHWVRQAPGKGLEWVAFIRYDGSNKYYADSVKGRFTISRDNSKNTKYLQMNSLRAEDTAVYYCAKDRFGYYLDYWGQGTLVTVSS

SEQ ID NO: 656 - protein, 108 aa, Artificial Sequence
  Description of Artificial Sequence: Synthetic polypeptide
  KYK-1.0[NKG2D]_L1 Variable Light
QPVLTQPSSVSVAPGETARIPCGGDDIETKSVHWYQQKPGQAPVLVIYDDDDRPSGIPERFFGSNSGNTATLSISRVEAGDEADYYCQVWDDNNDEWVFGGGTQLTVL

SEQ ID NO: 657 - protein, 121 aa, Artificial Sequence
  Description of Artificial Sequence: Synthetic polypeptide
  KYK-2.0[NKG2D]_H0 Variable Heavy
QVQLVESGGGLVKPGGSLRLSCAASGFTFSSYGMHWVRQAPGKGLEWVAFIRYDGSNKYYADSVKGRFTISRDNSKNTKYLQMNSLRAEDTAVYYCAKDRGLGDGTYFDYWGQGTTVTVSS

SEQ ID NO: 658 - protein, 110 aa, Artificial Sequence
  Description of Artificial Sequence: Synthetic polypeptide
  KYK-2.0[NKG2D]_L0 Variable Light
QSALTQPASVSGSPGQSITISCSGSSSNIGNNAVNWYQQLPGKAPKLLIYYDDLLPSGVSDRFSGSKSGTSAFLAISGLQSEDEADYYCAAWDDSLNGPVFGGGTKLTVL

SEQ ID NO: 659 - protein, 117 aa, Artificial Sequence
  Description of Artificial Sequence: Synthetic polypeptide
  11B2D10[NKG2D]_H0 Variable Heavy
QVQLQQSGPELVRPGASVKLSCKASGYTFTSYWMNWVQQRPEQGLEWIGRIDPYDSETHYNQKFKDKAILTVDKSASTAYMQLSSLTSEDSAVYYCAKMGDYSFDYWGQGTTVTVSS

SEQ ID NO: 660 - protein, 107 aa, Artificial Sequence
  Description of Artificial Sequence: Synthetic polypeptide
  11B2D10[NKG2D]_L0 Variable Light
DIQLTQSPASLSASVGETVTITCRASGNIHNYLAWYQQKQGKSPQVLVYNAKTLADGVPSRFSGSGSGTQYSLKINSLQPEDFGSYYCQHFWSTTWTFGGGTKLEIK

SEQ ID NO: 661 - protein, 120 aa, Artificial Sequence
  Description of Artificial Sequence: Synthetic polypeptide
  6E5A7[NKG2D]_H0 Variable Heavy
QVQLQQSGPGLVQPSQSLSITCTVSGFSLTIYGVHWVRQSPGKGLEWLGVIWSGGSTDYNAAFISRLSISKDNSKRQVFFKMSSLQANDTAIYYCSRKSHDGYYGVMDYWGQGTTVTVSS

SEQ ID NO: 662 - protein, 107 aa, Artificial Sequence
  Description of Artificial Sequence: Synthetic polypeptide
  6E5A7[NKG2D]_L0 Variable Light
DIQLTQSPAILSVSPGERVSFSCRASQSIGTSIHWYQQRTNGSPRLLIKYASESISGIPSRFSGSGSGTDFTLSINGVESEDIADYYCQQSNTWPLTFGAGTKLEIK

SEQ ID NO: 663 - protein, 119 aa, Artificial Sequence
  Description of Artificial Sequence: Synthetic polypeptide
  6H7E7[NKG2D]_H0 Variable Heavy
QVQLQESGPGLVAPSQSLSITCTVSGFSLTSYGVHWIRQPPGKGLEWLGVIWAGGSTNYNSALMSRLSISKDNSKSQVFLKMNSLQIDDTAMYYCARGGYEGAAWFGYWGQGTTVTVSS

SEQ ID NO: 664 - protein, 106 aa, Artificial Sequence
  Description of Artificial Sequence: Synthetic polypeptide
  6H7E7[NKG2D]_L0 Variable Light
DIQLTQSPAILSASPGEKVTMTCRASSSVSYMHWYQQKPGSSPKPWIYATSNLASGVPARFSGSGSGTSYSLTISRVEAEDAATYYCQQWNSNPLTFGAGTKLEIK

SEQ ID NO: 665 - protein, 121 aa, Artificial Sequence
  Description of Artificial Sequence: Synthetic polypeptide
  mAb E[NKG2D]_H1 Variable Heavy
EVQLVESGGGLVKPGGSLRLSCAASGFTFSSYSMNWVRQAPGKGLEWVSSITSSSSYIYYADSVKGRFTISRDNAKNSLYLQMNSLRAEDTAVYYCARDRRYFDWFPLDYRGQGTLVTVSS

SEQ ID NO: 666 - protein, 107 aa, Artificial Sequence
  Description of Artificial Sequence: Synthetic polypeptide
  mAb E[NKG2D]_L1 Variable Light
DIQMTQSPSSLSASVGDRVTITCRASQGISSWLAWYQQKPEKAPKSLIYAASSLQSGVPSRFSGSGSGTDFTLTISSLQPEDFATYYCQQYNGYPYTFGQGTKLEIK

SEQ ID NO: 667 - protein, 122 aa, Artificial Sequence
  Description of Artificial Sequence: Synthetic polypeptide
  16F31[NKG2D]_H1 Variable Heavy
EVQLVESGGGVVRPGGSLRLSCAASGFTFDDYGMTWVRQAPGKGLEWVSGINWNGGSTGYADSVKGRFTISRDNAKNSLYLQMNSLRAEDTALYYCARERELYYYYYGLDVWGQGTTVTVSS

SEQ ID NO: 668 - protein, 109 aa, Artificial Sequence
  Description of Artificial Sequence: Synthetic polypeptide
  16F31[NKG2D]_L1 Variable Light
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIKR

SEQ ID NO: 669 - protein, 122 aa, Artificial Sequence
  Description of Artificial Sequence: Synthetic polypeptide
  mAb D[NKG2D]_H1 Variable Heavy
QVQLVQSGAEVKKPGASVKVSCKASGYTFTNYWMHWVRQAPGQGLEWMGEIDPSDIYTNYAQKFQGRVTMTRDTSTSTVYMELSSLRSEDTAVYYCARGIYDGYYVYGMDYWGQGTTVTVSS

SEQ ID NO: 670 - protein, 107 aa, Artificial Sequence
  Description of Artificial Sequence: Synthetic polypeptide
  mAb D[NKG2D]_L1 Variable Light
YIQMTQSPSSLSASVGDRVTITCRSSQDISNYLNWYQQKPGKAPKLLIYYTSRLHSGVPSRFSGSGSGTDFTFTISSLQPEDIATYYCQQGKTLPRTFGGGTKVEIK

SEQ ID NO: 671 - protein, 121 aa, Artificial Sequence; identical to SEQ ID NO: 653
  Description of Artificial Sequence: Synthetic polypeptide
  1D7B4[NKG2D]_H1 Variable Heavy

SEQ ID NO: 672 - protein, 107 aa, Artificial Sequence; identical to SEQ ID NO: 650
  Description of Artificial Sequence: Synthetic polypeptide
  1D7B4[NKG2D]_L1 Variable Light

SEQ ID NO: 673 - protein, 119 aa, Artificial Sequence
  Description of Artificial Sequence: Synthetic polypeptide
  mAb A[NKG2D]_H1 Variable Heavy
QVQLVQSGAEVKKPGASVKVSCKVSGFSLTSYGVHWIRQAPGQGLEWMGVIWAGGSTNYNSKFQGRVTMTKDNSKSTVYMELSSLRSEDTAVYYCARGGYEGAAWFGYWGQGTLVTVSS

SEQ ID NO: 674 - protein, 119 aa, Artificial Sequence
  Description of Artificial Sequence: Synthetic polypeptide
  mAb A[NKG2D]_H2 Variable Heavy
QVQLQESGPGLVKPSETLSLTCTVSGFSLTSYGVHWIRQPPGKGLEWIGVIWAGGSTNYNPSLKSRVTISKDNSKSQVSLKLSSVTAADTAVYYCARGGYEGAAWFGYWGQGTLVTVSS

SEQ ID NO: 675 - protein, 106 aa, Artificial Sequence
  Description of Artificial Sequence: Synthetic polypeptide
  mAb A[NKG2D]_L1 Variable Light
DIQLTQSPSSLSASVGDRVTITCRASSSVSYMHWYQQKPGKSPKPLIYATSNLASGVPARFSGSGSGTDYTLTISSLQPEDFATYYCQQWNSNPLTFGAGTKVEIK

SEQ ID NO: 676 - protein, 106 aa, Artificial Sequence
  Description of Artificial Sequence: Synthetic polypeptide
  mAb A[NKG2D]_L2 Variable Light
DIQLTQSPATLSLSPGERATLSCRASSSVSYMHWYQQKPGQSPRPLIYATSNLASGVPARFSGSGSGTDYTLTISSLEPEDFAVYYCQQWNSNPLTFGAGTKVEIK

SEQ ID NO: 677 - protein, 117 aa, Artificial Sequence
  Description of Artificial Sequence: Synthetic polypeptide
  mAb B[NKG2D]_H1 Variable Heavy
QVQLVQSGAEVKKPGASVKVSCKASGYTFTSYWMNWVRQAPGQGLEWMGRIDPYDSETHYNQKFQGRVTMTVDKSTSTAYMELSSLRSEDTAVYYCAKMGDYSFDYWGQGTLVTVSS

SEQ ID NO: 678 - protein, 117 aa, Artificial Sequence
  Description of Artificial Sequence: Synthetic polypeptide
  mAb B[NKG2D]_H2 Variable Heavy
EVQLVQSGAEVKKPGESLRISCKASGYTFTSYWMNWVRQMPGKGLEWMGRIDPYDSETHYNPSFQGHVTISVDKSISTAYLQWSSLKASDTAMYYCAKMGDYSFDYWGQGTLVTVSS

SEQ ID NO: 679 - protein, 117 aa, Artificial Sequence
  Description of Artificial Sequence: Synthetic polypeptide
  mAb B[NKG2D]_H3 Variable Heavy
EVQLVESGGGLVQPGGSLRLSCAASGYTFTSYWMNWVRQAPGKGLVWVSRIDPYDSETHYNQKVKGRFTISVDKAKSTAYLQMNSLRAEDTAVYYCAKMGDYSFDYWGQGTLVTVSS

SEQ ID NO: 680 - protein, 107 aa, Artificial Sequence
  Description of Artificial Sequence: Synthetic polypeptide
  mAb B[NKG2D]_L1 Variable Light
DIQLTQSPSSLSASVGDRVTITCRASGNIHNYLAWYQQKPGKSPKVLVYNAKTLADGVPSRFSGSGSGTDYTLTISSLQPEDFATYYCQHFWSTTWTFGGGTKVEIK

SEQ ID NO: 681 - protein, 107 aa, Artificial Sequence
  Description of Artificial Sequence: Synthetic polypeptide
  mAb B[NKG2D]_L1.1 Variable Light
DIQLTQSPSSLSASVGDRVTITCRASGNIHNYLAWYQQKPGKSPKVLVYNAKTLADGVPSRFSGSGSGTDYTLTISSLQPEDFATYYCQHFWSTPWTFGGGTKVEIK

SEQ ID NO: 682 - protein, 107 aa, Artificial Sequence
  Description of Artificial Sequence: Synthetic polypeptide
  mAb B[NKG2D]_L2 Variable Light
DIQLTQSPDSLAVSLGERATINCKASGNIHNYLAWYQQKPGQSPKVLVYNAKTLADGVPSRFSGSGSGTDYTLTISSLQAEDVAVYYCQHFWSTTWTFGGGTKVEIK

SEQ ID NO: 683 - protein, 120 aa, Artificial Sequence
  Description of Artificial Sequence: Synthetic polypeptide
  mAb C[NKG2D]_H1 Variable Heavy
EVQLVESGGGLVQPGGSLRLSCAVSGFSLTIYGVHWVRQAPGKGLEWVSVIWSGGSTDYNAKVKGRFTISKDNSKRTVYLQMNSLRAEDTAVYYCSRKSHDGYYGVMDYWGQGTTVTVSS

SEQ ID NO: 684 - protein, 120 aa, Artificial Sequence
  Description of Artificial Sequence: Synthetic polypeptide
  mAb C[NKG2D]_H2 Variable Heavy
QVQLVQSGAEVKKPGASVKVSCKVSGFSLTIYGVHWVRQAPGQGLEWMGVIWSGGSTDYNAKFQGRVTMTKDNSKRTVYMELSSLRSEDTAVYYCSRKSHDGYYGVMDYWGQGTTVTVSS

SEQ ID NO: 685 - protein, 107 aa, Artificial Sequence
  Description of Artificial Sequence: Synthetic polypeptide
  mAb C[NKG2D]_L1 Variable Light
DIQLTQSPDFQSVTPKEKVTITCRASQSIGTSIHWYQQKPDQSPKLLIKYASESISGIPSRFSGSGSGTDFTLTINSLEAEDAATYYCQQSNTWPLTFGAGTKVEIK

SEQ ID NO: 686 - protein, 107 aa, Artificial Sequence
  Description of Artificial Sequence: Synthetic polypeptide
  mAb C[NKG2D]_L2 Variable Light
DIQLTQSPSSLSASVGDRVTITCRASQSIGTSIHWYQQKPGKSPKLLIKYASESISGIPSRFSGSGSGTDFTLTISSLQPEDFATYYCQQSNTWPLTFGAGTKVEIK

SEQ ID NO: 687 - protein, 447 aa, Artificial Sequence
  Description of Artificial Sequence: Synthetic polypeptide
  XENP25365 Chain 1 - OKT8_H2_IgG1_PVA_/S267K_pI(-)_Isosteric_A _L368D/K370S HC
QVQLVQSGAEVKKPGASVKVSCKASGFNIKDTYIHWVRQAPGKGLEWMGRIDPANDNTLYASKFQGRVTITADTSINTAYMELSRLRSDDTAVYYCGRGYGYYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 688 - protein, 397 aa, Artificial Sequence; identical to SEQ ID NO: 109
  Description of Artificial Sequence: Synthetic polypeptide
  XENP25365 Chain 2 - huIL10M1_Fc(216)_IgG1_C220S/S364K/E357Q

SEQ ID NO: 689 - protein, 214 aa, Artificial Sequence
  Description of Artificial Sequence: Synthetic polypeptide
  XENP25365 Chain 3 - OKT8_L1 LC
DIKMTQSPSSLSASVGDRVTITCRTSRSISQYLAWYQEKPGKTNKLLIYSGSTLQSGIPSRFSGSGSGTDFTLTISSLQPEDFATYYCQQHNENPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 690 - protein, 450 aa, Artificial Sequence
  Description of Artificial Sequence: Synthetic polypeptide
  XENP25366 Chain 1 - 1C11B3[CD8]_H1_IgG1_PVA_/S267K_pI(-) _Isosteric_A_L368D/K370S HC
EVQLLESGGGLVQPGGSLRLSCAASGFTFGSYAMSWVRQAPGKGLEWVSTITASGGTTFYADSVKGRFTISRDNSKNTLYLQMNSLRAEDTAVYYCAKDADGYGAIAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 691 - protein, 397 aa, Artificial Sequence; identical to SEQ ID NO: 109
  Description of Artificial Sequence: Synthetic polypeptide
  XENP25366 Chain 2 - huIL10M1_Fc(216)_IgG1_C220S/S364K/E357Q

SEQ ID NO: 692 - protein, 214 aa, Artificial Sequence
  Description of Artificial Sequence: Synthetic polypeptide
  XENP25366 Chain 3 - 1C11B3[CD8]_L1 LC
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 693 - protein, 628 aa, Artificial Sequence
  Description of Artificial Sequence: Synthetic polypeptide
  XENP26172 Chain 1 - OKT8_H2_IgG1_PVA_/S267K_(G4S)3_huIL10M1
QVQLVQSGAEVKKPGASVKVSCKASGFNIKDTYIHWVRQAPGKGLEWMGRIDPANDNTLYASKFQGRVTITADTSINTAYMELSRLRSDDTAVYYCGRGYGYYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 694 - protein, 214 aa, Artificial Sequence; identical to SEQ ID NO: 689
  Description of Artificial Sequence: Synthetic polypeptide
  XENP26172 Chain 2 - OKT8_L1 LC

SEQ ID NO: 695 - protein, 561 aa, Artificial Sequence; identical to SEQ ID NO: 94
  Description of Artificial Sequence: Synthetic polypeptide
  XENP25415 Chain 1 - huIL10_huIL10_(G4S)2_Fc(216)_pI(-) _Isosteric_A_C220S/PVA_/S267K/L368D/K370S

SEQ ID NO: 696 - protein, 447 aa, Artificial Sequence
  Description of Artificial Sequence: Synthetic polypeptide
  XENP25415 Chain 2 - OKT8_H2_IgG1_PVA_/S267K/S364K/E357Q HC
QVQLVQSGAEVKKPGASVKVSCKASGFNIKDTYIHWVRQAPGKGLEWMGRIDPANDNTLYASKFQGRVTITADTSINTAYMELSRLRSDDTAVYYCGRGYGYYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 697 - protein, 214 aa, Artificial Sequence; identical to SEQ ID NO: 689
  Description of Artificial Sequence: Synthetic polypeptide
  XENP25415 Chain 3 - OKT8_L1 LC

SEQ ID NO: 698 - protein, 447 aa, Artificial Sequence; identical to SEQ ID NO: 687
  Description of Artificial Sequence: Synthetic polypeptide
  XENP25791 Chain 1 - OKT8_H2_IgG1_PVA_/S267K_pI(-)_Isosteric_A _L368D/K370S

SEQ ID NO: 699 - protein, 561 aa, Artificial Sequence; identical to SEQ ID NO: 103
  Description of Artificial Sequence: Synthetic polypeptide
  XENP25791 Chain 2 - huIL10_huIL10_(G4S)2-Fc(216)_IgG1 _C220S/S364K/E357Q

SEQ ID NO: 700 - protein, 214 aa, Artificial Sequence; identical to SEQ ID NO: 689
  Description of Artificial Sequence: Synthetic polypeptide
  XENP25791 Chain 3 - OKT8_L1 LC

SEQ ID NO: 701 - protein, 447 aa, Artificial Sequence; identical to SEQ ID NO: 687
  Description of Artificial Sequence: Synthetic polypeptide
  XENP25794 Chain 1 - OKT8_H2_IgG1_PVA_/S267K_pI(-)_Isosteric_A _L368D/K370S HC

SEQ ID NO: 702 - protein, 576 aa, Artificial Sequence
  Description of Artificial Sequence: Synthetic polypeptide
  XENP25794 Chain 2 - huIL10_(G4S)3_huIL10_(G4S)2-Fc(216)_IgG1 _C220S/S364K/E357Q
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCLRFLPCENKSKAVEQVKNAFNKLQEKGIYKAMSEFDIFINYIEAYMTMKIRNGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 703 - protein, 214 aa, Artificial Sequence; identical to SEQ ID NO: 689
  Description of Artificial Sequence: Synthetic polypeptide
  XENP25794 Chain 3 - OKT8_L1 LC

SEQ ID NO: 704 - protein, 447 aa, Artificial Sequence; identical to SEQ ID NO: 687
  Description of Artificial Sequence: Synthetic polypeptide
  XENP26879 Chain 1 - OKT8_H2_IgG1_pI(-)_Isosteric_A_PVA _/S267K/L368D/K370S

SEQ ID NO: 705 - protein, 561 aa, Artificial Sequence; identical to SEQ ID NO: 103
  Description of Artificial Sequence: Synthetic polypeptide
  XENP26879 Chain 2 - huIL10_huIL10_(G4S)2_Fc(216)_IgG1_PVA _/S267K/S364K/E357Q

SEQ ID NO: 706 - protein, 214 aa, Artificial Sequence; identical to SEQ ID NO: 689
  Description of Artificial Sequence: Synthetic polypeptide
  XENP26879 Chain 3 - OKT8_L1 LC

SEQ ID NO: 707 - protein, 444 aa, Artificial Sequence
  Description of Artificial Sequence: Synthetic polypeptide
  XENP25952 Chain 1 - MS_H0_IgG1_PVA_/S267K_pI(-)_Isosteric_A _L368D/K370S HC
QVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 708 - protein, 561 aa, Artificial Sequence; identical to SEQ ID NO: 103
  Description of Artificial Sequence: Synthetic polypeptide
  XENP25952 Chain 2 - huIL10_huIL10_(G4S)2-Fc(216)_IgG1 _C220S/S364K/E357Q

SEQ ID NO: 709 - protein, 215 aa, Artificial Sequence
  Description of Artificial Sequence: Synthetic polypeptide
  XENP25952 Chain 3 - MS_L0 LC
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 710 - protein, 444 aa, Artificial Sequence; identical to SEQ ID NO: 707
  Description of Artificial Sequence: Synthetic polypeptide
  XENP30526 Chain 1 - MS[NKG2D]_H0_IgG1_pI(-)_Isosteric_A_PVA _/S267K/L368D/K370S

SEQ ID NO: 711 - protein, 560 aa, Artificial Sequence; identical to SEQ ID NO: 580
  Description of Artificial Sequence: Synthetic polypeptide
  XENP30526 Chain 2 - huIL10.104_huIL10.104_(G4S)2_IgG1 _C220S/PVA_/S267K/S364K/E357Q

SEQ ID NO: 712 - protein, 215 aa, Artificial Sequence; identical to SEQ ID NO: 709
  Description of Artificial Sequence: Synthetic polypeptide
  XENP30526 Chain 3 - MS[NKG2D]_L0

SEQ ID NO: 713 - protein, 444 aa, Artificial Sequence; identical to SEQ ID NO: 707
  Description of Artificial Sequence: Synthetic polypeptide
  XENP30527 Chain 1 - MS[NKG2D]_H0_IgG1_pI(-)_Isosteric_A_PVA _/S267K/L368D/K370S

SEQ ID NO: 714 - protein, 560 aa, Artificial Sequence; identical to SEQ ID NO: 28
  Description of Artificial Sequence: Synthetic polypeptide
  XENP30527 Chain 2 - huIL10.105_huIL10.105_(G4S)2_IgG1 _C220S/PVA_/S267K/S364K/E357Q

SEQ ID NO: 715 - protein, 215 aa, Artificial Sequence; identical to SEQ ID NO: 709
  Description of Artificial Sequence: Synthetic polypeptide
  XENP30527 Chain 3 - MS[NKG2D]_L0

SEQ ID NO: 716 - protein, 444 aa, Artificial Sequence; identical to SEQ ID NO: 707
  Description of Artificial Sequence: Synthetic polypeptide
  XENP30528 Chain 1 - MS[NKG2D]_H0_IgG1_pI(-)_Isosteric_A_PVA _/S267K/L368D/K370S

SEQ ID NO: 717 - protein, 560 aa, Artificial Sequence; identical to SEQ ID NO: 584
  Description of Artificial Sequence: Synthetic polypeptide
  XENP30528 Chain 2 - huIL10.107_huIL10.107_(G4S)2_IgG1 _C220S/PVA_/S267K/S364K/E357Q

SEQ ID NO: 718 - protein, 215 aa, Artificial Sequence; identical to SEQ ID NO: 709
  Description of Artificial Sequence: Synthetic polypeptide
  XENP30528 Chain 3 - MS[NKG2D]_L0

SEQ ID NO: 719 - protein, 444 aa, Artificial Sequence; identical to SEQ ID NO: 707
  Description of Artificial Sequence: Synthetic polypeptide
  XENP31819 Chain 1 - MS[NKG2D]_H0_IgG1_pI(-)_Isosteric_A_PVA _/S267K/L368D/K370S

SEQ ID NO: 720 - protein, 560 aa, Artificial Sequence; identical to SEQ ID NO: 26
  Description of Artificial Sequence: Synthetic polypeptide
  XENP31819 Chain 2 - huIL10.102_huIL10.102_(G4S)2_IgG1 _C220S/PVA_/S267K/S364K/E357Q

SEQ ID NO: 721 - protein, 215 aa, Artificial Sequence; identical to SEQ ID NO: 709
  Description of Artificial Sequence: Synthetic polypeptide
  XENP31819 Chain 3 - MS[NKG2D]_L0

SEQ ID NO: 722 - protein, 447 aa, Artificial Sequence; identical to SEQ ID NO: 687
  Description of Artificial Sequence: Synthetic polypeptide
  XENP26883 Chain 1 - OKT8_H2_IgG1_pI(-)_Isosteric_A_PVA _/S267K/L368D/K370S HC

SEQ ID NO: 723 - protein, 561 aa, Artificial Sequence; identical to SEQ ID NO: 288
  Description of Artificial Sequence: Synthetic polypeptide
  XENP26883 Chain 2 - huIL10.38_huIL10.38_(G4S)2_Fc(216)_IgG1 _PVA_/S267K/S364K/E357Q

SEQ ID NO: 724 - protein, 214 aa, Artificial Sequence; identical to SEQ ID NO: 689
  Description of Artificial Sequence: Synthetic polypeptide
  XENP26883 Chain 3 - OKT8_L1 LC

SEQ ID NO: 725 - protein, 117 aa, Artificial Sequence
  Description of Artificial Sequence: Synthetic polypeptide
  1C11[PD-1]_H0L0 Variable Heavy Chain
QIQLVQSGPELKKPGETVKISCRASGYTFTHYGMNWVKQAPGKGLKWMGWINTYTGEPTYADDFKGRFAFSLETSASTAYLQINNLKNEDTATYFCARDYYGSSPYWGQGTTLTVSS

SEQ ID NO: 726 - protein, 112 aa, Artificial Sequence
  Description of Artificial Sequence: Synthetic polypeptide
  1C11[PD-1]_H0L0 Variable Light Chain
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPNTFGGGTKLEIK

SEQ ID NO: 727 - protein, 117 aa, Artificial Sequence
  Description of Artificial Sequence: Synthetic polypeptide
  1C11[PD-1]_H3L3 Variable Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 728 - protein, 112 aa, Artificial Sequence
  Description of Artificial Sequence: Synthetic polypeptide
  1C11[PD-1]_H3L3 Variable Light Chain
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 729 - protein, 117 aa, Artificial Sequence
  Description of Artificial Sequence: Synthetic polypeptide
  1C11[PD-1]_H3.240_L3.148 Variable Heavy Chain
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSS

SEQ ID NO: 730 - protein, 112 aa, Artificial Sequence
  Description of Artificial Sequence: Synthetic polypeptide
  1C11[PD-1]_H3.240_L3.148 Variable Light Chain
DIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 731 - protein, 117 aa, Artificial Sequence
  Description of Artificial Sequence: Synthetic polypeptide
  1C11[PD-1]_H3.241_L3.148 Variable Heavy Chain
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSS

SEQ ID NO: 732 - protein, 112 aa, Artificial Sequence; identical to SEQ ID NO: 730
  Description of Artificial Sequence: Synthetic polypeptide
  1C11[PD-1]_H3.241_L3.148 Variable Light Chain

SEQ ID NO: 733 - protein, 117 aa, Artificial Sequence
  Description of Artificial Sequence: Synthetic polypeptide
  1C11[PD-1]_H3.234_L3.144 Variable Heavy Chain
EVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSS

SEQ ID NO: 734 - protein, 112 aa, Artificial Sequence
  Description of Artificial Sequence: Synthetic polypeptide
  1C11[PD-1]_H3.234_L3.144 Variable Light Chain
DIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 735 - protein, 117 aa, Artificial Sequence; identical to SEQ ID NO: 731
  Description of Artificial Sequence: Synthetic polypeptide
  1C11[PD-1]_H3.241_L3.92 Variable Heavy Chain

SEQ ID NO: 736 - protein, 112 aa, Artificial Sequence
  Description of Artificial Sequence: Synthetic polypeptide
  1C11[PD-1]_H3.241_L3.92 Variable Light Chain
DIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIK

SEQ ID NO: 737 - protein, 117 aa, Artificial Sequence
  Description of Artificial Sequence: Synthetic polypeptide
  1C11[PD-1]_H3.303_L3.152 Variable Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYFGSSPYWGQGTLVTVSS

SEQ ID NO: 738 - protein, 112 aa, Artificial Sequence
  Description of Artificial Sequence: Synthetic polypeptide
  1C11[PD-1]_H3.303_L3.152 Variable Light Chain
DVLMTQSPDSLAVSLGERATINCKSSQSIVFSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 739 - protein, 117 aa, Artificial Sequence
  Description of Artificial Sequence: Synthetic polypeptide
  1C11_H3.329_L3.220 Variable Heavy Chain
QIQLVQSGSELLKPGASVSVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSS

SEQ ID NO: 740 - protein, 112 aa, Artificial Sequence
  Description of Artificial Sequence: Synthetic polypeptide
  1C11_H3.329_L3.220 Variable Light Chain
DILMTQSPDSLAVSLGERATINCKSSQSIVYSNGNNYLEWYQQKPGQSPKLLIYKVSNRFSGVPDRFSGSGSGTDFTLTISSLQAEDVAVYYCFQGSHVPNTFGGGTKVEIK

SEQ ID NO: 741 - protein, 117 aa, Artificial Sequence
  Description of Artificial Sequence: Synthetic polypeptide
  1C11_H3.328_L3.152 Variable Heavy Chain
QIQLVQSGSELKKPGASVSVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSS

SEQ ID NO: 742 - protein, 112 aa, Artificial Sequence; identical to SEQ ID NO: 738
  Description of Artificial Sequence: Synthetic polypeptide
  1C11_H3.328_L3.152 Variable Light Chain

SEQ ID NO: 743 - protein, 120 aa, Artificial Sequence [sequence omitted]

SEQ ID NO: 744 - protein, 111 aa, Artificial Sequence [sequence omitted]

SEQ ID NO: 745 - protein, 113 aa, Artificial Sequence [sequence omitted]

SEQ ID NO: 746 - protein, 107 aa, Artificial Sequence [sequence omitted]

SEQ ID NO: 747 - protein, 117 aa, Artificial Sequence
  Description of Artificial Sequence: Synthetic polypeptide
  pidilizumab[PD-1] variable heavy Chain
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 748 - protein, 106 aa, Artificial Sequence
  Description of Artificial Sequence: Synthetic polypeptide
  pidilizumab[PD-1] variable light Chain
EIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIK

SEQ ID NO: 749 - protein, 120 aa, Artificial Sequence [sequence omitted]

SEQ ID NO: 750 - protein, 111 aa, Artificial Sequence [sequence omitted]

SEQ ID NO: 751 - protein, 117 aa, Artificial Sequence
  Description of Artificial Sequence: Synthetic polypeptide
  BAP049 Clone E[PD-1] variable heavy Chain
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSS

SEQ ID NO: 752 - protein, 113 aa, Artificial Sequence
  Description of Artificial Sequence: Synthetic polypeptide
  BAP049 Clone E[PD-1] variable light Chain
EIVLTQSPATLSLSPGERATLSCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 753 - protein, 117 aa, Artificial Sequence; identical to SEQ ID NO: 751
  Description of Artificial Sequence: Synthetic polypeptide
  BAP049 Clone B[PD-1] variable heavy Chain

SEQ ID NO: 754 - protein, 113 aa, Artificial Sequence
  Description of Artificial Sequence: Synthetic polypeptide
  BAP049 Clone B[PD-1] variable light Chain
EIVLTQSPATLSLSPGERATLSCKSSQSLLDSGNQKNFLTWYQQKPGKAPKLLIYWASTRESGVPSRFSGSGSGTDFTFTISSLQPEDIATYYCQNDYSYPYTFGQGTKVEIK

SEQ ID NO: 755 - protein, 117 aa, Artificial Sequence [sequence omitted]

SEQ ID NO: 756 - protein, 107 aa, Artificial Sequence [sequence omitted]

SEQ ID NO: 757 - protein, 122 aa, Artificial Sequence
  Description of Artificial Sequence: Synthetic polypeptide
  h1H3 Var 6[PD-1] variable heavy Chain
EVQLVESGGGLVQPGGSLRLSCAASGFTFSDYGMHWVRQAPGKGLEWVAYISSGSYTIYYADSVKGRFTISRDNAKNTLYLQMSSLRAEDTAVYYCARRGYGSFYEYYFDYWGQGTTVTVSS

SEQ ID NO: 758 - protein, 106 aa, Artificial Sequence
  Description of Artificial Sequence: Synthetic polypeptide
  h1H3 Var 6[PD-1] variable light Chain
QIVLTQSPATLSLSPGERATLSCSASSSVSYMYWYQQKPGQAPRLLIYLTSNRATGIPARFSGSGSGTDYTLTISSLEPEDFAVYYCQQWSSNPFTFGQGTKLEIK

SEQ ID NO: 759 - protein, 116 aa, Artificial Sequence
  Description of Artificial Sequence: Synthetic polypeptide
  APE2058[PD-1] variable heavy Chain
EVQLLESGGGLVQPGGSLRLSCAASGFTFSSYDMSWVRQAPGKGLEWVSTISGGGSYTYYQDSVKGRFTISRDNSKNTLYLQMNSLRAEDTAVYYCASPYYAMDYWGQGTTVTVSS

SEQ ID NO: 760 - protein, 107 aa, Artificial Sequence
  Description of Artificial Sequence: Synthetic polypeptide
  APE2058[PD-1] variable light Chain
DIQLTQSPSFLSAYVGDRVTITCKASQDVGTAVAWYQQKPGKAPKLLIYWASTLHTGVPSRFSGSGSGTEFTLTISSLQPEDFATYYCQHYSSYPWTFGQGTKLEIK

SEQ ID NO: 761 - protein, 116 aa, Artificial Sequence
  Description of Artificial Sequence: Synthetic polypeptide
  H005-1[PD-1] variable heavy Chain
EVQLVESGGGLVQPGGSLRLSCAASGFTFSSYMMSWVRQAPGKGLEWVATISGGGANTYYPDSVKGRFTISRDNAKNSLYLQMNSLRAEDTAVYYCARQLYYFDYWGQGTTVTVSS

SEQ ID NO: 762 - protein, 107 aa, Artificial Sequence
  Description of Artificial Sequence: Synthetic polypeptide
  H005-1[PD-1] variable light Chain
DIQMTQSPSSLSASVGDRVTITCLASQTIGTWLTWYQQKPGKAPKLLIYTATSLADGVPSRFSGSGSGTDFTLTISSLQPEDFATYYCQQVYSIPWTFGGGTKVEIK

SEQ ID NO: 763 - protein, 118 aa, Artificial Sequence
  Description of Artificial Sequence: Synthetic polypeptide
  317-4B6[PD-1] variable heavy Chain
QVQLQESGPGLVKPSETLSLTCTVSGFSLTSYGVHWIRQPPGKGLEWIGVIYADGSTNYNPSLKSRVTISKDTSKNQVSLKLSSVTAADTAVYYCARAYGNYWYIDVWGQGTTVTVSS

SEQ ID NO: 764 - protein, 107 aa, Artificial Sequence
  Description of Artificial Sequence: Synthetic polypeptide
  317-4B6[PD-1] variable light Chain
DIVMTQSPDSLAVSLGERATINCKSSESVSNDVAWYQQKPGQPPKLLINYAFHRFTGVPDRFSGSGYGTDFTLTISSLQAEDVAVYYCHQAYSSPYTFGQGTKLEIK

SEQ ID NO: 765 - protein, 114 aa, Artificial Sequence
  Description of Artificial Sequence: Synthetic polypeptide
  326-4A3[PD-1] variable heavy Chain
QVQLVQSGSELKKPGASVKVSCKASGYTFTNYGMNWVRQAPGQGLKWMGWINNNNAEPTYAQDFRGRFVFSLDTSASTAYLQISSLKTEDTAVYYCARDVMDYWGQGTLVTVSS

SEQ ID NO: 766 - protein, 110 aa, Artificial Sequence
  Description of Artificial Sequence: Synthetic polypeptide
  326-4A3[PD-1] variable light Chain
DIVLTQSPASLAVSPGQRATITCRASESVDNYGYSFMHWYQQKPGQPPKLLIYRASNLESGVPARFSGSGSGTDFTLTINPVEAEDTANYYCQQSKEYPTFGGGTKVEIK

SEQ ID NO: 767 - protein, 119 aa, Artificial Sequence
  Description of Artificial Sequence: Synthetic polypeptide
  hPD-1 mAb 7 (1.2)[PD-1] variable heavy Chain
QVQLVQSGAEVKKPGASVKVSCKASGYSFTSYWMNWVRQAPGQGLEWIGVIHPSDSETWLDQKFKDRVTITVDKSTSTAYMELSSLRSEDTAVYYCAREHYGTSPFAYWGQGTLVTVSS

SEQ ID NO: 768 - protein, 111 aa, Artificial Sequence
  Description of Artificial Sequence: Synthetic polypeptide
  hPD-1 mAb 7 (1.2)[PD-1] variable light Chain
EIVLTQSPATLSLSPGERATLSCRASESVDNYGMSFMNWFQQKPGQPPKLLIHAASNQGSGVPSRFSGSGSGTDFTLTISSLEPEDFAVYFCQQSKEVPYTFGGGTKVEIK

SEQ ID NO: 769 - protein, 125 aa, Artificial Sequence [sequence omitted]

SEQ ID NO: 770 - protein, 112 aa, Artificial Sequence [sequence omitted]

SEQ ID NO: 771 - protein, 125 aa, Artificial Sequence
  Description of Artificial Sequence: Synthetic polypeptide
  Clone 39[PD-1] variable heavy Chain
QGQLVQSGAEVKKPGASVKVSCKASGYTFTDYEMHWVRQAPGQGLEWMGVIESETGGTAYNQKFKGRAKITADKSTSTAYMELSSLRSEDTAVYYCTREGITTVATTYYWYFDVWGQGTTVTVSS

SEQ ID NO: 772 - protein, 112 aa, Artificial Sequence [sequence omitted]

SEQ ID NO: 773 - protein, 125 aa, Artificial Sequence
  Description of Artificial Sequence: Synthetic polypeptide
  Clone 41[PD-1] variable heavy Chain
QGQLVQSGAEVKKPGASVKVSCKASGYTFTDYEMHWVRQAPGQGLEWMGVIESETGGTAYNQKFQGRVTLTADKSSSTAYMELSSLRSEDTAVYYCTREGITTVATTYYWYFDVWGQGTLVTVSS

SEQ ID NO: 774 - protein, 112 aa, Artificial Sequence [sequence omitted]

SEQ ID NO: 775 - protein, 125 aa, Artificial Sequence; identical to SEQ ID NO: 771
  Description of Artificial Sequence: Synthetic polypeptide
  Clone 48[PD-1] variable heavy Chain

SEQ ID NO: 776 - protein, 112 aa, Artificial Sequence
  Description of Artificial Sequence: Synthetic polypeptide
  Clone 48[PD-1] variable light Chain
DVVMTQSPLSLPVTLGQPASISCRSSQSIVHSNGNTYLEWYLQKPGQSPRLLIYKVSNRFSGVPDRFSGSGSGTDFTLKISRVEAEDVGVYYCFQGSHVPLTFGQGTKLEIK

SEQ ID NO: 777 - protein, 128 aa, Artificial Sequence
  Description of Artificial Sequence: Synthetic polypeptide
  PD1-17[PD-1] variable heavy Chain
QVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSS

SEQ ID NO: 778 - protein, 110 aa, Artificial Sequence
  Description of Artificial Sequence: Synthetic polypeptide
  PD1-17[PD-1] variable light Chain
NFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVL

SEQ ID NO: 779 - protein, 119 aa, Artificial Sequence
  Description of Artificial Sequence: Synthetic polypeptide
  PD1-28[PD-1] variable heavy Chain
EVQLVQSGAEVKKPGASVKVSCKASGYRFTSYGISWVRQAPGQGLEWMGWISAYNGNTNYAQKLQGRVTMTTDTSTNTAYMELRSLRSDDTAVYYCARDADYSSGSGYWGQGTLVTVSS

SEQ ID NO: 780 - protein, 108 aa, Artificial Sequence
  Description of Artificial Sequence: Synthetic polypeptide
  PD1-28[PD-1] variable light Chain
SYELTQPPSVSVSPGQTARITCSGDALPKQYAYWYQQKPGQAPVMVIYKDTERPSGIPERFSGSSSGTKVTLTISGVQAEDEADYYCQSADNSITYRVFGGGTKVTVL

SEQ ID NO: 781 - protein, 119 aa, Artificial Sequence
  Description of Artificial Sequence: Synthetic polypeptide
  PD1-33[PD-1] variable heavy Chain
QVQLVQSGAEVKKPGASVRVSCKASGYTLTSYYIHWVRQAPGQGLEWMGIINPRGATISYAQKFQGRVTMTRDTSTSTVYMELRNLKSEDTALYYCATAGIYGFDFDYWGRGTLVTVSS

SEQ ID NO: 782 - protein, 111 aa, Artificial Sequence
  Description of Artificial Sequence: Synthetic polypeptide
  PD1-33[PD-1] variable light Chain
QSALTQPASVSGSPGQSITISCTGTSNDVGGYNYVSWYQHHPGKAPKLIIYDVTNRPSGVSDRFSGSKSGNTASLTISGLLAEDEGDYYCSSYTIVTNFEVLFGGGTKLTV

SEQ ID NO: 783 - protein, 127 aa, Artificial Sequence
  Description of Artificial Sequence: Synthetic polypeptide
  PD1-35[PD-1] variable heavy Chain
QVQLQESGPGLVKPSQTLSLTCTVSGGSISSGAYYWSWIRQHPGKGLEWIGYIYYNGNTYYNPSLRSLVTISVDASKNQFSLKLSSVTAADTAVYYCARASDYVWGGYRYMDAFDIWGRGTLITVSS

SEQ ID NO: 784 - protein, 112 aa, Artificial Sequence
  Description of Artificial Sequence: Synthetic polypeptide
  PD1-35[PD-1] variable light Chain
QSVLTQPPSASGTPGQRVTISCSGSNSNIGSNSVNWYQQLPGTAPKLLIYGNNQRPSGVPDRFSGSKSGTSASLAISGLQSENEADYYCAAWDDSLNGPVFGRGTKVTVLGE

SEQ ID NO: 785 - protein, 127 aa, Artificial Sequence
  Description of Artificial Sequence: Synthetic polypeptide
  LOPD180[PD-1] variable heavy Chain
QVQLQESGPGLVKPSQTLSLTCTVSGGSISSGAYYWSWIRQHPGKGLEWIGYIYYNGNTYYNPSLRSRVTISVDTSKNQFSLKLSSVTAADTAVYYCVRASDYVWGGYHYFDAFDLWGRGTLVTVSS

SEQ ID NO: 786 - protein, 110 aa, Artificial Sequence
  Description of Artificial Sequence: Synthetic polypeptide
  LOPD180[PD-1] variable light Chain
QSVLTQPPSASGTPGQRVTISCSGSNSNIGSNSVNWYQQLPGTAPKLLIYGNNQRPSGVPDRFSGSKSGTSASLAISGLQSEDEADYYCAAWDDSLNGPVFGGGTKVTVL

SEQ ID NO: 787 - protein, 119 aa, Artificial Sequence
  Description of Artificial Sequence: Synthetic polypeptide
  Ab948[PD-1] variable heavy Chain
EVQLQESGPGLVKPSQTLSLTCTVTGYSITSDYAWNWIRQPPGKKLEWMGYINYSGSTSYNPSLKSRVTISRDTSKNQFSLKLSSVTAADTAVYYCARWIGSSAWYFDVWGQGTLVTVS

SEQ ID NO: 788 - protein, 112 aa, Artificial Sequence
  Description of Artificial Sequence: Synthetic polypeptide
  Ab948[PD-1] variable light Chain
DVLMTQTPLSLSVTPGQPASISCRSGQNIVHSNGNTYLEWYLQKPGQSPKLLIYKVSNRFFGVPDRISGSGSGTDFTLKISRVEAEDVGVYFCFQGSHVPFTFGQGTKLEIK

SEQ ID NO: 789 - protein, 121 aa, Artificial Sequence
  Description of Artificial Sequence: Synthetic polypeptide
  humanized EH-12.2H7[PD-1] variable heavy Chain
QVQLVQSGHEVKQPGASVKMSCKASGYSFTSSWIHWVRQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 790 - protein, 111 aa, Artificial Sequence
  Description of Artificial Sequence: Synthetic polypeptide
  humanized EH-12.2H7[PD-1] variable light Chain
EIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 791 - protein, 119 aa, Artificial Sequence
  Description of Artificial Sequence: Synthetic polypeptide
  RG1H10[PD-1] variable heavy Chain
QVQLVQSGSELKKPGASVKISCKASGYIFSDNGVNWVRQAPGQGLEWMGWINTKIGNPTYAQGFTGRFVFSLDTSISTTYLQISSLQAGDTAVYYCAREHDYYYGMDVWGQGTTVTVSS

SEQ ID NO: 792 - protein, 111 aa, Artificial Sequence
  Description of Artificial Sequence: Synthetic polypeptide
  RG1H10[PD-1] variable light Chain
QSALTQPPSASGSPGQSVTISCTGTSSDVGGYNYVSWYQHHPGKAPKLMIYEVSKRPSGVPDRFSGSKSAITASLTISGLLTEDEADYYCSAWDDSLNADVFGGGTKVTVL

SEQ ID NO: 793 - protein, 119 aa, Artificial Sequence
  Description of Artificial Sequence: Synthetic polypeptide
  RG1H10-H2A-22-1S[PD-1] variable heavy Chain
QVQLVQSGSELKKPGASVKISCKASGYIFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 794 - protein, 111 aa, Artificial Sequence; identical to SEQ ID NO: 792
  Description of Artificial Sequence: Synthetic polypeptide
  RG1H10-H2A-22-1S[PD-1] variable light Chain

SEQ ID NO: 795 - protein, 119 aa, Artificial Sequence
  Description of Artificial Sequence: Synthetic polypeptide
  RG1H10-H2A-27-2S[PD-1] variable heavy Chain
QVQLVQSGSELKKPGASVKISCKASGYIFSDNGVNWVRQAPGQGLEWMGWINTKTGNPTYAQGFTGRFVFSLDTSISTTYLQISSLQAGDTAVYYCAREHDYYYGMDVWGQGTTVTVSS

SEQ ID NO: 796 - protein, 111 aa, Artificial Sequence; identical to SEQ ID NO: 792
  Description of Artificial Sequence: Synthetic polypeptide
  RG1H10-H2A-27-2S[PD-1] variable light Chain

SEQ ID NO: 797 - protein, 119 aa, Artificial Sequence
  Description of Artificial Sequence: Synthetic polypeptide
  RG1H10-3C[PD-1] variable heavy Chain
QVQLVQSGSELKKPGASVKISCKASGYTFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 798 - protein, 111 aa, Artificial Sequence; identical to SEQ ID NO: 792
  Description of Artificial Sequence: Synthetic polypeptide
  RG1H10-3C[PD-1] variable light Chain

SEQ ID NO: 799 - protein, 118 aa, Artificial Sequence
  Description of Artificial Sequence: Synthetic polypeptide
  RG1H10-16C[PD-1] variable heavy Chain
QVQLVQSGSELKKPGASVKISCKASGYTFSDNGVNWVRQAPGQGLEWMGWINTKTGNPTYAQGFTGRFVFSLDTSISTTYLQISSLQAGDTAVYYCAREHDYYYGMDVWGQGTTVTVS

SEQ ID NO: 800 - protein, 111 aa, Artificial Sequence; identical to SEQ ID NO: 792
  Description of Artificial Sequence: Synthetic polypeptide
  RG1H10-16C[PD-1] variable light Chain

SEQ ID NO: 801 - protein, 119 aa, Artificial Sequence
  Description of Artificial Sequence: Synthetic polypeptide
  RG1H10-17C[PD-1] variable heavy Chain
QVQLVQSGSELKKPGASVKISCKASGYKFSDNGVNWVRQAPGQGLEWMGWINTKSGNPTYAQGFTGRFVFSLDTSISTTYLQISSLQAGDTAVYYCAREHDYYYGMDVWGQGTTVTVSS

SEQ ID NO: 802 - protein, 111 aa, Artificial Sequence; identical to SEQ ID NO: 792
  Description of Artificial Sequence: Synthetic polypeptide
  RG1H10-17C[PD-1] variable light Chain

SEQ ID NO: 803 - protein, 119 aa, Artificial Sequence
  Description of Artificial Sequence: Synthetic polypeptide
  RG1H10-19C[PD-1] variable heavy Chain
QVQLVQSGSELKKPGASVKISCKASGYKFSDNGVNWVRQAPGQGLEWMGWINTKTGNPTYAQGFTGRFVFSLDTSISTTYLQISSLQAGDTAVYYCAREHDYYYGMDVWGQGTTVTVSS

SEQ ID NO: 804 - protein, 111 aa, Artificial Sequence; identical to SEQ ID NO: 792
  Description of Artificial Sequence: Synthetic polypeptide
  RG1H10-19C[PD-1] variable light Chain

SEQ ID NO: 805 - protein, 119 aa, Artificial Sequence
  Description of Artificial Sequence: Synthetic polypeptide
  RG1H10-21C[PD-1] variable heavy Chain
QVQLVQSGSELKKPGASVKISCKASGYTFSDNGVNWVRQAPGQGLEWMGWINTKSGNPTYAQGFTGRFVFSLDTSISTTYLQISSLQAGDTAVYYCAREHDYYYGMDVWGQGTTVTVSS

SEQ ID NO: 806 - protein, 111 aa, Artificial Sequence; identical to SEQ ID NO: 792
  Description of Artificial Sequence: Synthetic polypeptide
  RG1H10-21C[PD-1] variable light Chain

SEQ ID NO: 807 - protein, 119 aa, Artificial Sequence
  Description of Artificial Sequence: Synthetic polypeptide
  RG1H10-23C2[PD-1] variable heavy Chain
QVQLVQSGSELKKPGASVKISCKASGYKFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 808 - protein, 111 aa, Artificial Sequence; identical to SEQ ID NO: 792
  Description of Artificial Sequence: Synthetic polypeptide
  RG1H10-23C2[PD-1] variable light Chain

SEQ ID NO: 809 - protein, 117 aa, Artificial Sequence
  Description of Artificial Sequence: Synthetic polypeptide
  mAb7[PD-1] variable heavy Chain
QVQLVQSGAEVKKPGASVKVSCKASGYTFTSYWINWVRQAPGQGLEWMGNIYPGSSLTNYNEKFKNRVTMTRDTSTSTVYMELSSLRSEDTAVYYCARLSTGTFAYWGQGTLVTVSS

SEQ ID NO: 810 - protein, 113 aa, Artificial Sequence
  Description of Artificial Sequence: Synthetic polypeptide
  mAb7[PD-1] variable light Chain
DIVMTQSPDSLAVSLGERATINCKSSQSLWDSGNQKNFLTWYQQKPGQPPKLLIYWTSYRESGVPDRFSGSGSGTDFTLTISSLQAEDVAVYYCQNDYFYPHTFGGGTKVEIK

SEQ ID NO: 811 - protein, 124 aa, Artificial Sequence
  Description of Artificial Sequence: Synthetic polypeptide
  PD1AB-6[PD-1] variable heavy Chain
EVQLVQSGAEVKKPGATVKISCKASGFNIKDTYMHWVQQAPGKGLEWMGRIDPANGDRKYDPKFQGRVTITADTSTDTAYMELSSLRSEDTAVYYCARSGPVYYYGSSYVMDYWGQGTTVTVSS

SEQ ID NO: 812 - protein, 112 aa, Artificial Sequence
  Description of Artificial Sequence: Synthetic polypeptide
  PD1AB-6[PD-1] variable light Chain
DIVMTQSPDSLAVSLGERATINCKSGQSVLYSSNQKNFLAWYQQKPGQPPKLLIYWASTRESGVPDRFSGSGSGTDFTLTISSLQAEDVAVYYCHQYLYSWTFGQGTKLEIK

SEQ ID NO: 813 - protein, 446 aa, Artificial Sequence
  Description of Artificial Sequence: Synthetic polypeptide
  XENP25953 Chain 1 - 1C11[PD-1]_H3_IgG1_PVA_/S267K_pI(-) _Isosteric_A_L368D/K370S HC
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 814 - protein, 561 aa, Artificial Sequence; identical to SEQ ID NO: 103
  Description of Artificial Sequence: Synthetic polypeptide
  XENP25953 Chain 2 - huIL10_huIL10_(G4S)2-Fc(216)_IgG1 _C220S/S364K/E357Q

SEQ ID NO: 815 - protein, 219 aa, Artificial Sequence
  Description of Artificial Sequence: Synthetic polypeptide
  XENP25953 Chain 3 - 1C11[PD-1]_L3 LC
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 816 - protein, 446 aa, Artificial Sequence; identical to SEQ ID NO: 813
  Description of Artificial Sequence: Synthetic polypeptide
  XENP27830 Chain 1 - 1C11[PD-1]_H3_IgG1_pI(-)_Isosteric_A_PVA _/S267K/L368D/K370S

SEQ ID NO: 817 - protein, 561 aa, Artificial Sequence; identical to SEQ ID NO: 278
  Description of Artificial Sequence: Synthetic polypeptide
  XENP27830 Chain 2 - huIL10.22_huIL10.22_(G4S)2_Fc(216)_IgG1 _C220S/PVA_/S267K/S364K/E357Q

SEQ ID NO: 818 - protein, 219 aa, Artificial Sequence; identical to SEQ ID NO: 815
  Description of Artificial Sequence: Synthetic polypeptide
  XENP27830 Chain 3 - 1C11[PD-1]_L3 LC

SEQ ID NO: 819 - protein, 446 aa, Artificial Sequence; identical to SEQ ID NO: 813
  Description of Artificial Sequence: Synthetic polypeptide
  XENP27831 Chain 1 - 1C11[PD-1]_H3_IgG1_pI(-)_Isosteric_A_PVA _/S267K/L368D/K370S

SEQ ID NO: 820 - protein, 561 aa, Artificial Sequence; identical to SEQ ID NO: 326
  Description of Artificial Sequence: Synthetic polypeptide
  XENP27831 Chain 2 - huIL10.64_huIL10.64_(G4S)2_Fc(216)_IgG1 _C220S/PVA_/S267K/S364K/E357Q

SEQ ID NO: 821 - protein, 219 aa, Artificial Sequence; identical to SEQ ID NO: 815
  Description of Artificial Sequence: Synthetic polypeptide
  XENP27831 Chain 3 - 1C11[PD-1]_L3 LC

SEQ ID NO: 822 - protein, 446 aa, Artificial Sequence; identical to SEQ ID NO: 813
  Description of Artificial Sequence: Synthetic polypeptide
  XENP31269 Chain 1 - 1C11[PD-1]_H3_IgG1_pI(-)_Isosteric_A_PVA _/S267K/L368D/K370S

SEQ ID NO: 823 - protein, 560 aa, Artificial Sequence; identical to SEQ ID NO: 26
  Description of Artificial Sequence: Synthetic polypeptide
  XENP31269 Chain 2 - huIL10.102_huIL10.102_(G4S)2_IgG1 _C220S/PVA_/S267K/S364K/E357Q

SEQ ID NO: 824 - protein, 219 aa, Artificial Sequence; identical to SEQ ID NO: 815
  Description of Artificial Sequence: Synthetic polypeptide
  XENP31269 Chain 3 - 1C11[PD-1]_L3

SEQ ID NO: 825 - protein, 446 aa, Artificial Sequence; identical to SEQ ID NO: 813
  Description of Artificial Sequence: Synthetic polypeptide
  XENP31270 Chain 1 - 1C11[PD-1]_H3_IgG1_pI(-)_Isosteric_A_PVA _/S267K/L368D/K370S

SEQ ID NO: 826 - protein, 560 aa, Artificial Sequence; identical to SEQ ID NO: 28
  Description of Artificial Sequence: Synthetic polypeptide
  XENP31270 Chain 2 - huIL10.105_huIL10.105_(G4S)2_IgG1 _C220S/PVA_/S267K/S364K/E357Q

SEQ ID NO: 827 - protein, 219 aa, Artificial Sequence; identical to SEQ ID NO: 815
  Description of Artificial Sequence: Synthetic polypeptide
  XENP31270 Chain 3 - 1C11[PD-1]_L3

SEQ ID NO: 828 - protein, 446 aa, Artificial Sequence; identical to SEQ ID NO: 813
  Description of Artificial Sequence: Synthetic polypeptide
  XENP31271 Chain 1 - 1C11[PD-1]_H3_IgG1_pI(-)_Isosteric_A_PVA _/S267K/L368D/K370S

SEQ ID NO: 829 - protein, 565 aa, Artificial Sequence; identical to SEQ ID NO: 598
  Description of Artificial Sequence: Synthetic polypeptide
  XENP31271 Chain 2 - empty_Fc_Fc(216)_IgG1_C220S/PVA _/S267K/S364K/E357Q/K447del_(G4S)3_huIL10.102_huIL10.102

SEQ ID NO: 830 - protein, 219 aa, Artificial Sequence; identical to SEQ ID NO: 815
  Description of Artificial Sequence: Synthetic polypeptide
  XENP31271 Chain 3 - 1C11[PD-1]_L3

SEQ ID NO: 831 - protein, 446 aa, Artificial Sequence; identical to SEQ ID NO: 813
  Description of Artificial Sequence: Synthetic polypeptide
  XENP31272 Chain 1 - 1C11[PD-1]_H3_IgG1_pI(-)_Isosteric_A_PVA _/S267K/L368D/K370S

SEQ ID NO: 832 - protein, 565 aa, Artificial Sequence; identical to SEQ ID NO: 604
  Description of Artificial Sequence: Synthetic polypeptide
  XENP31272 Chain 2 - empty_Fc_Fc(216)_IgG1_C220S/PVA _/S267K/S364K/E357Q/K447del_(G4S)3_huIL10.105_huIL10.105

SEQ ID NO: 833 - protein, 219 aa, Artificial Sequence
  Description of Artificial Sequence: Synthetic polypeptide
  XENP31272 Chain 3 - 1C11[PD-1]_L3
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWZVDNALQSGNSQESVTEQDSKDSTYSLSSTLTLSKADYEKHKVYACEVTHQGLSSPVTKSFNRGEC

SEQ ID NO: 834 - protein, 119 aa, Artificial Sequence
  Description of Artificial Sequence: Synthetic polypeptide
  mAb A[PD-1]_H1 Variable Heavy
QVQLQESGPGLVKPSQTLSLTCTVSGHSITSDYAWNWIRQPPGKKLEWIGYISYSGYTTYNPSLKSRVTISRDTSKNQFSLKLSSVTAADTAVYFCARDLDYGPWFAYWGQGTLVTVSS

SEQ ID NO: 835 - protein, 107 aa, Artificial Sequence
  Description of Artificial Sequence: Synthetic polypeptide
  mAb A[PD-1]_L1 Variable Light
DIQMTQSPSSLSASVGDRVTITCRASENIHNYLAWYQQKPGKSPKLLVYNVKTLADGVPSRFSGSGSGTDYTLTISSLQPEDFATYYCQHFWSSPWTFGGGTKVEIK

SEQ ID NO: 836 - protein, 117 aa, Artificial Sequence
  Description of Artificial Sequence: Synthetic polypeptide
  mAb B[PD-1]_H1 Variable Heavy
QVQLVQSGAEVKKPGASVKVSCKASGYTFTNFYIHWVRQAPGQSIEWMGSIYPNYGDTAYNQKFQGRVTMTVDKSISTAYMELSRLRSDDTAVYYCARGYSYAMDYWGQGTTVTVSS

SEQ ID NO: 837 - protein, 107 aa, Artificial Sequence
  Description of Artificial Sequence: Synthetic polypeptide
  mAb B[PD-1]_L1 Variable Light
DIQMTQSPSSLSASVGDRVTITCRASQGISGDLNWYQQKPGKTVKLLIYHTSSLHSGVPLRFSGSGSGTDYTLTISSLQPEDFATYYCQYYSKDLLTFGAGTKLEIK

SEQ ID NO: 838 - protein, 119 aa, Artificial Sequence
  Description of Artificial Sequence: Synthetic polypeptide
  mAb C[PD-1]_H1 Variable Heavy
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 839 - protein, 119 aa, Artificial Sequence
  Description of Artificial Sequence: Synthetic polypeptide
  mAb C[PD-1]_H1.19 Variable Heavy
EVQLVESGGGLVQPGGSLRLSCAASGFTFSSLGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 840 - protein, 119 aa, Artificial Sequence
  Description of Artificial Sequence: Synthetic polypeptide
  mAb C[PD-1]_H1.48 Variable Heavy
EVQLVESGGGLVQPGGSLRLSCAASGFTFSSFGMHWVRQAPGKGLEWVSYISGGSSIIYYADSVKGRFTISRDNAKNSLYLQMNSLRAEDTAVYYCARGGRLVWSPDYWGQGTLVTVSS

SEQ ID NO: 841 - protein, 119 aa, Artificial Sequence
  Description of Artificial Sequence: Synthetic polypeptide
  mAb C[PD-1]_H1.125 Variable Heavy
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGELVWSPDYWGQGTLVTVSS

SEQ ID NO: 842 - protein, 119 aa, Artificial Sequence
  Description of Artificial Sequence: Synthetic polypeptide
  mAb C[PD-1]_H1.130 Variable Heavy
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGYLVWSPDYWGQGTLVTVSS

SEQ ID NO: 843 - protein, 119 aa, Artificial Sequence
  Description of Artificial Sequence: Synthetic polypeptide
  mAb C[PD-1]_H1.132 Variable Heavy
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGWLVWSPDYWGQGTLVTVSS

SEQ ID NO: 844 - protein, 119 aa, Artificial Sequence
  Description of Artificial Sequence: Synthetic polypeptide
  mAb C[PD-1]_H1.169 Variable Heavy
EVQLVESGGGLVQPGGSLRLSCAASGFTFSSLGMHWVRQAPGKGLEWVSYISGGSSIIYYADSVKGRFTISRDNAKNSLYLQMNSLRAEDTAVYYCARGGRLVWSPDYWGQGTLVTVSS

SEQ ID NO: 845 - protein, 119 aa, Artificial Sequence
  Description of Artificial Sequence: Synthetic polypeptide
  mAb C[PD-1]_H1.175 Variable Heavy
EVQLVESGGGLVQPGGSLRLSCAASGFTFSSLGMHWVRQAPGKGLEWVSYISGGSSIIYYADSVKGRFTISRDNAKNSLYLQMNSLRAEDTAVYYCARGGWLVWSPDYWGQGTLVTVSS

SEQ ID NO: 846 - protein, 119 aa, Artificial Sequence
  Description of Artificial Sequence: Synthetic polypeptide
  mAb C[PD-1]_H2 Variable Heavy
EVQLVESGGGLVKPGGSLRLSCAASGFTFSSFGMHWVRQAPGKGLEWVGYISSGSSIIYYADPVKGRFTISRDNSKNTLYLQMNSLKTEDTAVYYCARGGRLVWSPDYWGQGTLVTVSS

SEQ ID NO: 847 - protein, 113 aa, Artificial Sequence
  Description of Artificial Sequence: Synthetic polypeptide
  mAb C[PD-1]_L1 Variable Light
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSYPFTFGSGTKLEIK

SEQ ID NO: 848 - protein, 113 aa, Artificial Sequence
  Description of Artificial Sequence: Synthetic polypeptide
  mAb C[PD-1]_L1.1 Variable Light
DIVMTQSPDSLAVSLGERATINCKSSQSLLHSGNQKNYLTWYQQKPGQPPKLLIYWASTRESGVPDRFTGSGSGTDFTLTISSLQAEDVAVYYCQNDYSYPFTFGSGTKLEIK

SEQ ID NO: 849 - protein, 113 aa, Artificial Sequence
  Description of Artificial Sequence: Synthetic polypeptide
  mAb C[PD-1]_L1.3 Variable Light
DIVMTQSPDSLAVSLGERATINCKSSQSLLSSGNQKNYLTWYQQKPGQPPKLLIYWASTRESGVPDRFTGSGSGTDFTLTISSLQAEDVAVYYCQNDYSYPFTFGSGTKLEIK

SEQ ID NO: 850 - protein, 113 aa, Artificial Sequence
  Description of Artificial Sequence: Synthetic polypeptide
  mAb C[PD-1]_L1.45 Variable Light
DIVMTQSPDSLAVSLGERATINCKSSQSLLNSGNQYNYLTWYQQKPGQPPKLLIYWASTRESGVPDRFTGSGSGTDFTLTISSLQAEDVAVYYCQNDYSYPFTFGSGTKLEIK

SEQ ID NO: 851 - protein, 113 aa, Artificial Sequence
  Description of Artificial Sequence: Synthetic polypeptide
  mAb C[PD-1]_L1.117 Variable Light
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYTYPFTFGSGTKLEIK

SEQ ID NO: 852 - protein, 113 aa, Artificial Sequence
  Description of Artificial Sequence: Synthetic polypeptide
  mAb C[PD-1]_L1.129 Variable Light
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSWPFTFGSGTKLEIK

SEQ ID NO: 853 - protein, 113 aa, Artificial Sequence
  Description of Artificial Sequence: Synthetic polypeptide
  mAb C[PD-1]_L1.135 Variable Light
DIVMTQSPDSLAVSLGERATINCKSSQSLLHSGNQYNYLTWYQQKPGQPPKLLIYWASTRESGVPDRFTGSGSGTDFTLTISSLQAEDVAVYYCQNDYSYPFTFGSGTKLEIK

SEQ ID NO: 854 - protein, 113 aa, Artificial Sequence
  Description of Artificial Sequence: Synthetic polypeptide
  mAb C[PD-1]_L1.136 Variable Light
DIVMTQSPDSLAVSLGERATINCKSSQSLLHSGNQKNYLTWYQQKPGQPPKLLIYWASTRESGVPDRFTGSGSGTDFTLTISSLQAEDVAVYYCQNDYTYPFTFGSGTKLEIK

SEQ ID NO: 855 - protein, 113 aa, Artificial Sequence
  Description of Artificial Sequence: Synthetic polypeptide
  mAb C[PD-1]_L1.140 Variable Light
DIVMTQSPDSLAVSLGERATINCKSSQSLLHSGNQYNYLTWYQQKPGQPPKLLIYWASTRESGVPDRFTGSGSGTDFTLTISSLQAEDVAVYYCQNDYTYPFTFGSGTKLEIK

SEQ ID NO: 856 - protein, 113 aa, Artificial Sequence
  Description of Artificial Sequence: Synthetic polypeptide
  mAb C[PD-1]_L2 Variable Light
DIVMTQSPLSLPVTPGEPASISCRSSQSLLNSGNQKNYLTWYLQKPGQPPQLLIYWASTRESGVPDRFTGSGSGTDFTLKISRVEAEDVGVYYCQNDYSYPFTFGSGTKLEIK

SEQ ID NO: 857 - protein, 448 aa, Artificial Sequence
  Description of Artificial Sequence: Synthetic polypeptide
  XENP30520 Chain 1 - mAb C[PD-1]_H1_IgG1_pI(-)_Isosteric_A_PVA _/S267K/L368D/K370S
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 858 - protein, 560 aa, Artificial Sequence; identical to SEQ ID NO: 580
  Description of Artificial Sequence: Synthetic polypeptide
  XENP30520 Chain 2 - huIL10.104_huIL10.104_(G4S)2_IgG1 _C220S/PVA_/S267K/S364K/E357Q

SEQ ID NO: 859 - protein, 220 aa, Artificial Sequence
  Description of Artificial Sequence: Synthetic polypeptide
  XENP30520 Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGTDFTLTISSLQAEDVAVYYCQNDYSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 860 - protein, 448 aa, Artificial Sequence; identical to SEQ ID NO: 857
  Description of Artificial Sequence: Synthetic polypeptide
  XENP30521 Chain 1 - mAb C[PD-1]_H1_IgG1_pI(-)_Isosteric_A_PVA _/S267K/L368D/K370S

SEQ ID NO: 861 - protein, 560 aa, Artificial Sequence; identical to SEQ ID NO: 28
  Description of Artificial Sequence: Synthetic polypeptide
  XENP30521 Chain 2 - huIL10.105_huIL10.105_(G4S)2_IgG1 _C220S/PVA_/S267K/S364K/E357Q

SEQ ID NO: 862 - protein, 220 aa, Artificial Sequence; identical to SEQ ID NO: 859
  Description of Artificial Sequence: Synthetic polypeptide
  XENP30521 Chain 3 - mAb C[PD-1]_L1.1

SEQ ID NO: 863 - protein, 448 aa, Artificial Sequence; identical to SEQ ID NO: 857
  Description of Artificial Sequence: Synthetic polypeptide
  XENP30522 Chain 1 - mAb C[PD-1]_H1_IgG1_pI(-)_Isosteric_A_PVA _/S267K/L368D/K370S

SEQ ID NO: 864 - protein, 560 aa, Artificial Sequence; identical to SEQ ID NO: 584
  Description of Artificial Sequence: Synthetic polypeptide
  XENP30522 Chain 2 - huIL10.107_huIL10.107_(G4S)2_IgG1 _C220S/PVA_/S267K/S364K/E357Q

SEQ ID NO: 865 - protein, 220 aa, Artificial Sequence; identical to SEQ ID NO: 859
  Description of Artificial Sequence: Synthetic polypeptide
  XENP30522 Chain 3 - mAb C[PD-1]_L1.1

SEQ ID NO: 866 - protein, 448 aa, Artificial Sequence; identical to SEQ ID NO: 857
  Description of Artificial Sequence: Synthetic polypeptide
  XENP31266 Chain 1 - mAb C[PD-1]_H1_IgG1_pI(-)_Isosteric_A_PVA _/S267K/L368D/K370S

SEQ ID NO: 867 - protein, 560 aa, Artificial Sequence; identical to SEQ ID NO: 26
  Description of Artificial Sequence: Synthetic polypeptide
  XENP31266 Chain 2 - huIL10.102_huIL10.102_(G4S)2_IgG1 _C220S/PVA_/S267K/S364K/E357Q

SEQ ID NO: 868 - protein, 220 aa, Artificial Sequence; identical to SEQ ID NO: 859
  Description of Artificial Sequence: Synthetic polypeptide
  XENP31266 Chain 3 - mAb C[PD-1]_L1.1

SEQ ID NO: 869 - protein, 448 aa, Artificial Sequence; identical to SEQ ID NO: 857
  Description of Artificial Sequence: Synthetic polypeptide
  XENP31267 Chain 1 - mAb C[PD-1]_H1_IgG1_pI(-)_Isosteric_A_PVA _/S267K/L368D/K370S

SEQ ID NO: 870 - protein, 565 aa, Artificial Sequence; identical to SEQ ID NO: 598
  Description of Artificial Sequence: Synthetic polypeptide
  XENP31267 Chain 2 - empty_Fc_Fc(216)_IgG1_C220S/PVA _/S267K/S364K/E357Q/K447del_(G4S)3_huIL10.102_huIL10.102

SEQ ID NO: 871 - protein, 220 aa, Artificial Sequence; identical to SEQ ID NO: 859
  Description of Artificial Sequence: Synthetic polypeptide
  XENP31267 Chain 3 - mAb C[PD-1]_L1.1

SEQ ID NO: 872 - protein, 448 aa, Artificial Sequence; identical to SEQ ID NO: 857
  Description of Artificial Sequence: Synthetic polypeptide
  XENP31268 Chain 1 - mAb C[PD-1]_H1_IgG1_pI(-)_Isosteric_A_PVA _/S267K/L368D/K370S

SEQ ID NO: 873 - protein, 565 aa, Artificial Sequence; identical to SEQ ID NO: 604
  Description of Artificial Sequence: Synthetic polypeptide
  XENP31268 Chain 2 - empty_Fc_Fc(216)_IgG1_C220S/PVA _/S267K/S364K/E357Q/K447del_(G4S)3_huIL10.105_huIL10.105

SEQ ID NO: 874 - protein, 220 aa, Artificial Sequence; identical to SEQ ID NO: 859
  Description of Artificial Sequence: Synthetic polypeptide
  XENP31268 Chain 3 - mAb C[PD-1]_L1.1

SEQ ID NO: 875 - protein, 199 aa, Homo sapiens
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 876 - protein, 120 aa, Homo sapiens
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLK

SEQ ID NO: 877 - protein, 199 aa, Macaca fascicularis
MKSGLWYFFLFCLHMKVLTGEINGSANYEMFIFHNGGVQILCKYPDIVQQFKMQLLKGGQILCDLTKTKGSGNTVSIKSLKFCHSQLSNNSVSFFLYNLDRSHANYYFCNLSIFDPPPFKVTLTGGYLHIYESQLCCQLKFWLPIGCATFVVVCIFGCILICWLTKKKYSSTVHDPNGEYMFMRAVNTAKKSRLTDVTV

SEQ ID NO: 878 - protein, 120 aa, Macaca fascicularis
EINGSANYEMFIFHNGGVQILCKYPDIVQQFKMQLLKGGQILCDLTKTKGSGNTVSIKSLKFCHSQLSNNSVSFFLYNLDRSHANYYFCNLSIFDPPPFKVTLTGGYLHIYESQLCCQLK

SEQ ID NO: 879 - protein, 450 aa, Artificial Sequence
  Description of Artificial Sequence: Synthetic polypeptide
  XENP27507 Heavy Chain - 2A5B4[TIGIT]_H1L1_IgG1_PVA_/S267K
EVQLLESGGGLVQPGGSLRLSCAASGFTFSSYAMSWVRQAPGKGLEWVSGISGSGGTTYYADSVKGRFTISRDNSKNTLYLQMNSLRAEDTAVYYCAKGPVYSARRGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 880 - protein, 214 aa, Artificial Sequence; identical to SEQ ID NO: 692
  Description of Artificial Sequence: Synthetic polypeptide
  XENP27507 Light Chain - 2A5B4[TIGIT]_H1L1_IgG1_PVA_/S267K

SEQ ID NO: 881 - protein, 448 aa, Artificial Sequence
  Description of Artificial Sequence: Synthetic polypeptide
  XENP19351 Heavy Chain - 10A7_H0_IgG1_PVA_/S267K
EVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 882 - protein, 220 aa, Artificial Sequence
  Description of Artificial Sequence: Synthetic polypeptide
  XENP19351 Light Chain - 10A7_L0
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 883 - protein, 448 aa, Artificial Sequence
  Description of Artificial Sequence: Synthetic polypeptide
  XENP19352 Heavy Chain - 1F4_H0_IgG1_PVA_/S267K
EVQLQQSGPELVKPGTSMKISCKASGYSFTGHLMNWVKQSHGKNLEWIGLIIPYNGGTSYNQKFKGKATLTVDKSSSTAYMELLSLTSDDSAVYFCSRGLRGFYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 884 - protein, 219 aa, Artificial Sequence
  Description of Artificial Sequence: Synthetic polypeptide
  XENP19352 Light Chain - 1F4_L0
DVVLTQTPLSLSVSFGDQVSISCRSSQSLVNSYGNTFLSWYLHKPGQSPQLLIFGISNRFSGVPDRFSGSGSGTDFTLKISTIKPEDLGMYYCLQGTHQPPTFGPGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 885 - protein, 121 aa, Artificial Sequence
  Description of Artificial Sequence: Synthetic polypeptide
  2A5B4[TIGIT]_H1 Variable Heavy
EVQLLESGGGLVQPGGSLRLSCAASGFTFSSYAMSWVRQAPGKGLEWVSGISGSGGTTYYADSVKGRFTISRDNSKNTLYLQMNSLRAEDTAVYYCAKGPVYSARRGFDYWGQGTLVTVSS

SEQ ID NO: 886 - protein, 107 aa, Artificial Sequence; identical to SEQ ID NO: 650
  Description of Artificial Sequence: Synthetic polypeptide
  2A5B4[TIGIT]_L1 Variable Light

SEQ ID NO: 887 - protein, 126 aa, Artificial Sequence
  Description of Artificial Sequence: Synthetic polypeptide
  Genentech_4.1D3.Q1E(tiragolumab)[TIGIT]_H0 Variable Heavy
EVQLQQSGPGLVKPSQTLSLTCAISGDSVSSNSAAWNWIRQSPSRGLEWLGKTYYRFKWYSDYAVSVKGRITINPDTSKNQFSLQLNSVTPEDTAVFYCTRESTTYDLLAGPFDYWGQGTLVTVSS

SEQ ID NO: 888 - protein, 113 aa, Artificial Sequence
  Description of Artificial Sequence: Synthetic polypeptide
  Genentech_4.1D3.Q1E(tiragolumab)[TIGIT]_L0 Variable Light
DIVMTQSPDSLAVSLGERATINCKSSQTVLYSSNNKKYLAWYQQKPGQPPNLLIYWASTRESGVPDRFSGSGSGTDFTLTISSLQAEDVAVYYCQQYYSTPFTFGPGTKVEIK

SEQ ID NO: 889 - protein, 119 aa, Artificial Sequence
  Description of Artificial Sequence: Synthetic polypeptide
  10A7[TIGIT] variable heavy Chain
EVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSS

SEQ ID NO: 890 - protein, 113 aa, Artificial Sequence
  Description of Artificial Sequence: Synthetic polypeptide
  10A7[TIGIT] variable light Chain
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIK

SEQ ID NO: 891 - protein, 119 aa, Artificial Sequence
  Description of Artificial Sequence: Synthetic polypeptide
  1F4[TIGIT] variable heavy Chain
EVQLQQSGPELVKPGTSMKISCKASGYSFTGHLMNWVKQSHGKNLEWIGLIIPYNGGTSYNQKFKGKATLTVDKSSSTAYMELLSLTSDDSAVYFCSRGLRGFYAMDYWGQGTSVTVSS

SEQ ID NO: 892 - protein, 112 aa, Artificial Sequence
  Description of Artificial Sequence: Synthetic polypeptide
  1F4[TIGIT] variable light Chain
DVVLTQTPLSLSVSFGDQVSISCRSSQSLVNSYGNTFLSWYLHKPGQSPQLLIFGISNRFSGVPDRFSGSGSGTDFTLKISTIKPEDLGMYYCLQGTHQPPTFGPGTKLEVK

SEQ ID NO: 893 - protein, 126 aa, Artificial Sequence
  Description of Artificial Sequence: Synthetic polypeptide
  4.1D3[TIGIT] variable heavy Chain
QVQLQQSGPGLVKPSQTLSLTCAISGDSVSSNSAAWNWIRQSPSRGLEWLGKTYYRFKWYSDYAVSVKGRITINPDTSKNQFSLQLNSVTPEDTAVFYCTRESTTYDLLAGPFDYWGQGTLVTVSS

SEQ ID NO: 894 - protein, 113 aa, Artificial Sequence; identical to SEQ ID NO: 888
  Description of Artificial Sequence: Synthetic polypeptide
  4.1D3[TIGIT] variable light Chain

SEQ ID NO: 895 - protein, 121 aa, Artificial Sequence
  Description of Artificial Sequence: Synthetic polypeptide
  Hu14D7 VH1[TIGIT] variable heavy Chain
EVQLVESGGGLVQPGGSLKLSCAASGFTFSGAWMDWVRQAPGKGLEWVAEIRTKVNNHATNYGESVKGRFTISRDDSKSTVYLQMNSLRAEDTAVYYCRGALYDGFYFDYWGQGTLVTVSS

SEQ ID NO: 896 - protein, 121 aa, Artificial Sequence
  Description of Artificial Sequence: Synthetic polypeptide
  Hu14D7 VH2[TIGIT] variable heavy Chain
EVQLVESGGGLVQPGGSLKLSCAASGFTFSGAWMDWVRQAPGKGLEWVAEIRTKVNNHATNYGESVKGRFTISRDDSKSSVYLQMNSLRAEDTAVYYCRGALYDGFYFDYWGQGTLVTVSS

SEQ ID NO: 897 - protein, 121 aa, Artificial Sequence
  Description of Artificial Sequence: Synthetic polypeptide
  Hu14D7 VH3[TIGIT] variable heavy Chain
EVQLVESGGGLVQPGGSLKLSCAASGFTFSGAWMDWVRQAPGKGLEWVAEIRTKVNNHATNYGESVKGRFTISRDDSKNTVYLQMNSLRAEDTAVYYCRGALYDGFYFDYWGQGTLVTVSS

SEQ ID NO: 898 - protein, 108 aa, Artificial Sequence
  Description of Artificial Sequence: Synthetic polypeptide
  Hu14D7 VL1[TIGIT] variable light Chain
EIVLTQSPATLSLSPGERATLSCSASSSVSSGYLYWYQQKPGQAPKLWIYGTSTLASGVPARFSGSGSGTDYTLTISSLEPEDFAVYYCHQWSSFPYTFGQGTKLEIK

SEQ ID NO: 899 - protein, 108 aa, Artificial Sequence
  Description of Artificial Sequence: Synthetic polypeptide
  Hu14D7 VL2[TIGIT] variable light Chain
EIVLTQSPATLSLSPGERATLSCSASSSVSSGYLYWYQQKPGQAPRLWIYGTSTLASGVPARFSGSGSGTDYTLTISSLEPEDFAVYYCHQWSSFPYTFGQGTKLEIK

SEQ ID NO: 900 - protein, 108 aa, Artificial Sequence
  Description of Artificial Sequence: Synthetic polypeptide
  Hu14D7 VL3[TIGIT] variable light Chain
EIVLTQSPATLSLSPGERATLSCSASSSVSSGYLYWYQQKPGQAPRLWIYGTSTLASGIPARFSGSGSGTDYTLTISSLEPEDFAVYYCHQWSSFPYTFGQGTKLEIK

SEQ ID NO: 901 - protein, 119 aa, Artificial Sequence
  Description of Artificial Sequence: Synthetic polypeptide
  Hu26B10 VH1[TIGIT] variable heavy Chain
EVQLVQSGAEVKKPGASVKISCKTSGYTFTEFTMHWVKQAPGKGLEWIGGLKPDNGGISYNQKFKGRATLTVDKSTNTAYMELSSLRSEDTAVYYCARGAYYRYDADYWGQGTLVTVSS

SEQ ID NO: 902 - protein, 119 aa, Artificial Sequence
  Description of Artificial Sequence: Synthetic polypeptide
  Hu26B10 VH2[TIGIT] variable heavy Chain
EVQLVQSGAEVKKPGASVKISCKTSGYTFTEFTMHWVRQAPGKGLEWIGGLKPDNGGISYNQKFKGRATLTVDKSTSTAYMELSSLRSEDTAVYYCARGAYYRYDADYWGQGTLVTVSS

SEQ ID NO: 903 - protein, 119 aa, Artificial Sequence
  Description of Artificial Sequence: Synthetic polypeptide
  Hu26B10 VH3[TIGIT] variable heavy Chain
EVQLVQSGAEVKKPGASVKISCKVSGYTFTEFTMHWVRQAPGKGLEWIGGLKPDNGGISYNQKFKGRATLTVDTSTSTAYMELSSLRSEDTAVYYCARGAYYRYDADYWGQGTLVTVSS

SEQ ID NO: 904 - protein, 107 aa, Artificial Sequence
  Description of Artificial Sequence: Synthetic polypeptide
  Hu26B10 VL1[TIGIT] variable light Chain
DIQLTQSPSSLSASVGDRVTITCKASQDVKTAVAWYQQKPGKAPKLLIYSASYRNTGVPDRFSGSGSGTDFTFTISSLQPEDFATYYCQQHYSTPFTFGQGTKLEIK

SEQ ID NO: 905 - protein, 107 aa, Artificial Sequence
  Description of Artificial Sequence: Synthetic polypeptide
  Hu26B10 VL2[TIGIT] variable light Chain
DIQLTQSPSSLSASVGDRVTITCKASQDVKTAVAWYQQKPGKAPKLLIYSASYRNTGVPSRFSGSGSGTDFTFTISSLQPEDFATYYCQQHYSTPFTFGQGTKLEIK

SEQ ID NO: 906 - protein, 107 aa, Artificial Sequence
  Description of Artificial Sequence: Synthetic polypeptide
  Hu26B10 VL3[TIGIT] variable light Chain
DIQLTQSPSSLSASVGDRVTITCKASQDVKTAVAWYQQKPGKAPKLLIYSASYRNTGVPSRFSGSGSGTDFTLTISSLQPEDFATYYCQQHYSTPFTFGQGTKLEIK

SEQ ID NO: 907 - protein, 119 aa, Artificial Sequence
  Description of Artificial Sequence: Synthetic polypeptide
  MEB125.31C6.A1.205 VH4/VL1[TIGIT] variable heavy Chain
EVQLVQSGAEVKKPGASVKVSCKASGYTFSSYVMHWVRQAPGQGLEWIGYIDPYNDGAKYAQKFQGRVTLTSDKSTSTVYMELSSLRSEDTAVYYCARGGPYGWYFDVWGQGTTVTVSS

SEQ ID NO: 908 - protein, 107 aa, Artificial Sequence
  Description of Artificial Sequence: Synthetic polypeptide
  MEB125.31C6.A1.205 VH4/VL1[TIGIT] variable light Chain
DIQMTQSPSSLSASVGDRVTITCRASEHIYSYLSWYQQKPGKAPKLLIYNAKTLAEGVPSRFSGSGSGTDFTLTISSLQPEDFATYYCQHHFGSPLTFGQGTRLEIK

SEQ ID NO: 909 - protein, 119 aa, Artificial Sequence
  Description of Artificial Sequence: Synthetic polypeptide
  MEB125.31C6.A1.205 VH5/VL4[TIGIT] variable heavy Chain
EVQLVQSGAEVKKPGSSVKVSCKASGYTFSSYVMHWVRQAPGQGLEWIGYIDPYNDGAKYAQKFQGRVTLTSDKSTSTAYMELSSLRSEDTAVYYCARGGPYGWYFDVWGQGTTVTVSS

SEQ ID NO: 910 - protein, 107 aa, Artificial Sequence
  Description of Artificial Sequence: Synthetic polypeptide
  MEB125.31C6.A1.205 VH5/VL4[TIGIT] variable light Chain
DIQMTQSPSSLSASVGDRVTITCRASEHIYSYLSWYQQKPGKVPKLLIYNAKTLAEGVPSRFSGSGSGTQFTLTISSLQPEDVATYYCQHHFGSPLTFGQGTRLEIK

SEQ ID NO: 911 - protein, 119 aa, Artificial Sequence; identical to SEQ ID NO: 909
  Description of Artificial Sequence: Synthetic polypeptide
  MEB125.31C6.A1.205 VH5/VL3[TIGIT] variable heavy Chain

SEQ ID NO: 912 - protein, 107 aa, Artificial Sequence
  Description of Artificial Sequence: Synthetic polypeptide
  MEB125.31C6.A1.205 VH5/VL3[TIGIT] variable light Chain
DIQMTQSPSSLSASVGDRVTITCRASEHIYSYLSWYQQKPGKVPKLLIYNAKTLAEGVPSRFSGSGSGTDFTLTISSLQPEDVATYYCQHHFGSPLTFGQGTRLEIK

SEQ ID NO: 913 - protein, 118 aa, Artificial Sequence
  Description of Artificial Sequence: Synthetic polypeptide
  15A6[TIGIT] variable heavy Chain
QLQLQESGPGLVKPSETLSLTCTVSGGSISSSRYFWGWIRQPPGKGLEWIGYIYYRGSTYYNPSLKSRVTIAVDTSKNQFSLKLSSVTAADTAVYYCASSSAWYFDYWGQGNLVTVSS

SEQ ID NO: 914 - protein, 107 aa, Artificial Sequence
  Description of Artificial Sequence: Synthetic polypeptide
  15A6[TIGIT] variable light Chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSLYTFGQGTKLEIK

SEQ ID NO: 915 - protein, 130 aa, Artificial Sequence
  Description of Artificial Sequence: Synthetic polypeptide
  22G2[TIGIT] variable heavy Chain
QVHLQESGPGLVKPSETLSLTCTVSGGSVSSGIYYWSWIRQPPGKGLEWIGYIYYSGSTNYNPSLKSRVTISVDTSKNQFSLKLSSVTAADTAVYYCARDYYVSGNYYNVDYYFFGVDVWGQGTTVTVSS

SEQ ID NO: 916 - protein, 109 aa, Artificial Sequence
  Description of Artificial Sequence: Synthetic polypeptide
  22G2[TIGIT] variable light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPLFTFGPGTKVDIK

SEQ ID NO: 917 - protein, 126 aa, Artificial Sequence
  Description of Artificial Sequence: Synthetic polypeptide
  11G11[TIGIT] variable heavy Chain
QLQLQESGPGLVKPSETLSLTCTVSGGSISSSSHYWGWIRQPPGKGLEWIGNIFYSGHTYYNPSLKSRVTISVDTSKNQFSLKLSSVTAADTAVYYCARQGLLWFGGLSPYYFDYWGQGTLVTVSS

SEQ ID NO: 918 - protein, 106 aa, Artificial Sequence
  Description of Artificial Sequence: Synthetic polypeptide
  11G11[TIGIT] variable light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKLEIK

SEQ ID NO: 919 - protein, 128 aa, Artificial Sequence
  Description of Artificial Sequence: Synthetic polypeptide
  10D7[TIGIT] variable heavy Chain
QGQLVQSGAEVKKPGSSVKVSCKASGGIFRNYAISWVRQAPGQGLEWMGGIIPFFGTANYAQKFQGRVTITADESTSTAYMELSSLRSEDTAVYYCARGGAAAGTTRYGYYYYGMDVWGQGTTVTVSS

SEQ ID NO: 920 - protein, 107 aa, Artificial Sequence
  Description of Artificial Sequence: Synthetic polypeptide
  10D7[TIGIT] variable light Chain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPITFGQGTRLEIK

SEQ ID NO: 921 - protein, 116 aa, Artificial Sequence
  Description of Artificial Sequence: Synthetic polypeptide
  313R19[TIGIT] variable heavy Chain
QVQLQESGPGLVKPSETLSLTCTVSGFSLSSSYMSWIRQPPGKGLEWIGIIGSNGNTYYANWAKGRVTISKSSNQVSLKLSSVTAADTAVYYCARGGYRTSGMDPWGQGTLVTVSS

SEQ ID NO: 922 - protein, 110 aa, Artificial Sequence
  Description of Artificial Sequence: Synthetic polypeptide
  313R19[TIGIT] variable light Chain
DIQMTQSPSSLSASVGDRVTITCQASQNIYSDLAWYQQKPGKAPKLLIYRASTLASGVPSRFSGSGSGTDFTLTISSLQPEDFATYYCQQEHLVAWIYNVFGQGTKVEIK

SEQ ID NO: 923 - protein, 118 aa, Artificial Sequence
  Description of Artificial Sequence: Synthetic polypeptide
  etigilimab[TIGIT] variable heavy Chain
QVQLQESGPGLVKPSETLSLTCAVSGYSITSDYAWNWIRQPPGKGLEWIGYISYSGSTSYNPSLRSRVTISRDTSKNQFFLKLSSVTAADTAVYYCARRQVGLGFAYWGQGTLVTVSS

SEQ ID NO: 924 - protein, 107 aa, Artificial Sequence
  Description of Artificial Sequence: Synthetic polypeptide
  etigilimab[TIGIT] variable light Chain
DIQMTQSPSSLSASVGDRVTITCKASQDVSTAVAWYQQKPGKAPKLLIYSASYRYTGVPSRFSGSGSGTDFTFTISSLQPEDIATYYCQQHYSTPWTFGQGTKVEIK

SEQ ID NO: 925 - protein, 450 aa, Artificial Sequence
  Description of Artificial Sequence: Synthetic polypeptide
  XENP30523 Chain 1 - 2A5B4[TIGIT]_H1_IgG1_pI(-)_Isosteric_A _PVA_/S267K/L368D/K370S
EVQLLESGGGLVQPGGSLRLSCAASGFTFSSYAMSWVRQAPGKGLEWVSGISGSGGTTYYADSVKGRFTISRDNSKNTLYLQMNSLRAEDTAVYYCAKGPVYSARRGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 926 - protein, 560 aa, Artificial Sequence; identical to SEQ ID NO: 580
  Description of Artificial Sequence: Synthetic polypeptide
  XENP30523 Chain 2 - huIL10.104_huIL10.104_(G4S)2_IgG1 _C220S/PVA_/S267K/S364K/E357Q

SEQ ID NO: 927 - protein, 214 aa, Artificial Sequence; identical to SEQ ID NO: 692
  Description of Artificial Sequence: Synthetic polypeptide
  XENP30523 Chain 3 - 2A5B4[TIGIT]_L1

SEQ ID NO: 928 - protein, 450 aa, Artificial Sequence; identical to SEQ ID NO: 925
  Description of Artificial Sequence: Synthetic polypeptide
  XENP30524 Chain 1 - 2A5B4[TIGIT]_H1_IgG1_pI(-)_Isosteric_A _PVA_/S267K/L368D/K370S

SEQ ID NO: 929 - protein, 560 aa, Artificial Sequence; identical to SEQ ID NO: 28
  Description of Artificial Sequence: Synthetic polypeptide
  XENP30524 Chain 2 - huIL10.105_huIL10.105_(G4S)2_IgG1 _C220S/PVA_/S267K/S364K/E357Q

SEQ ID NO: 930 - protein, 214 aa, Artificial Sequence; identical to SEQ ID NO: 692
  Description of Artificial Sequence: Synthetic polypeptide
  XENP30524 Chain 3 - 2A5B4[TIGIT]_L1

SEQ ID NO: 931 - protein, 450 aa, Artificial Sequence; identical to SEQ ID NO: 925
  Description of Artificial Sequence: Synthetic polypeptide
  XENP30525 Chain 1 - 2A5B4[TIGIT]_H1_IgG1_pI(-)_Isosteric_A _PVA_/S267K/L368D/K370S

SEQ ID NO: 932 - protein, 560 aa, Artificial Sequence; identical to SEQ ID NO: 584
  Description of Artificial Sequence: Synthetic polypeptide
  XENP30525 Chain 2 - huIL10.107_huIL10.107_(G4S)2_IgG1 _C220S/PVA_/S267K/S364K/E357Q

SEQ ID NO: 933 - protein, 214 aa, Artificial Sequence; identical to SEQ ID NO: 692
  Description of Artificial Sequence: Synthetic polypeptide
  XENP30525 Chain 3 - 2A5B4[TIGIT]_L1

What is claimed is:

1. A composition comprising a variant interleukin-10 (IL-10) monomer domain consisting of a parent IL-10 monomer domain with an amino acid substitution or a set of amino acid substitutions,
wherein the parent IL-10 monomer domain is SEQ ID NO:3 or SEQ ID NO:4;
wherein the amino acid substitution or the set of amino acid substitutions are selected from the group consisting of: N21D, D28N, Q38E, Q42E, D44N, N45D, E142Q, D144N, E151Q, Q38E/D41N, Q38E/Q42E, Q38E/N45D, Q38E/E142Q, Q38E/D144N, D41N/Q42E, D41N/N45D, D41N/E142Q, D41N/D144N, Q42E/N45D, Q42E/E142Q, Q42E/D144N, N45D/E142Q, N45D/D144N, E142Q/D144N, N21D/Q42E, N21D/N45D, N21D/E151Q, N21D/N45E, Q42E/E151Q, N45D/E151Q, N21D/Q42E/N45D, N21D/Q42E/E151Q, Q42E/N45D/E151Q, N21D/Q42E/N45E, and N21D/Q42E/N45D/E151Q of SEQ ID NO:3 or SEQ ID NO:4.

2. The composition of claim 1, wherein the variant IL-10 monomer domain comprises a set of amino acid substitutions selected from the group consisting of Q38E/D41N, Q38E/Q42E, Q38E/N45D, Q38E/E142Q, Q38E/D144N, D41N/Q42E, D41N/N45D, D41N/E142Q, D41N/D144N, Q42E/N45D, Q42E/E142Q, Q42E/D144N, N45D/E142Q, N45D/D144N, E142Q/D144N, N21D/Q42E, N21D/N45D, N21D/E151Q, N21D/N45E, Q42E/E151Q, N45D/E151Q, N21D/Q42E/N45D, N21D/Q42E/E151Q, Q42E/N45D/E151Q, N21D/Q42E/N45E, and N21D/Q42E/N45D/E151Q.

3. The composition of claim 1, wherein the amino acid substitution or set of amino acid substitutions is selected from the group consisting of N45D, N45D/D144N, and Q38E/N45D of SEQ ID NO:3 or SEQ ID NO:4.

4. The composition of claim 1, wherein the variant IL-10 monomer domain comprises the amino acid sequence of SEQ ID NO:562.

5. The composition of claim 1, wherein the variant IL-10 monomer domain comprises the amino acid sequence of SEQ ID NO:568.

6. The composition of claim 1, wherein the variant IL-10 monomer domain comprises the amino acid sequence of SEQ ID NO:571.

7. The composition of claim 1, wherein the variant IL-10 monomer domain comprises the amino acid sequence of SEQ ID NO:132.

8. The composition of claim 1, wherein the variant IL-10 monomer domain comprises the amino acid sequence of SEQ ID NO:139.

9. The composition of claim 1, wherein the variant IL-10 monomer domain comprises the amino acid sequence of SEQ ID NO:150.

10. The composition of claim 1, wherein the variant IL-10 monomer domain comprises the amino acid sequence of SEQ ID NO:171.

11. The composition of claim 1, wherein the variant IL-10 monomer domain comprises the amino acid sequence of SEQ ID NO:178.

12. The composition of claim 1, wherein the variant IL-10 monomer domain comprises the amino acid sequence of SEQ ID NO:189.

13. The composition of claim 1, wherein the amino acid substitution or set of amino acid substitutions are selected from the group consisting of N21D, Q38E, Q42E, N45D, E142Q, E151Q, Q38E/D41N, Q38E/Q42E, Q38E/N45D, Q38E/E142Q, Q38E/D144N, D41N/Q42E, D41N/N45D, D41N/E142Q, D41N/D144N, Q42E/N45D, Q42E/E142Q, Q42E/D144N, N45D/E142Q, N45D/D144N, E142Q/D144N, N21D/Q42E, N21D/N45D, N21D/E151Q, N21D/N45E, Q42E/E151Q, N45D/E151Q, N21D/Q42E/N45D, N21D/Q42E/E151Q, Q42E/N45D/E151Q, N21D/Q42E/N45E, and N21D/Q42E/N45D/E151Q of SEQ ID NO:3 or SEQ ID NO:4.

* * * * *

UNITED STATES PATENT AND TRADEMARK OFFICE
CERTIFICATE OF CORRECTION

| | | |
|---|---|---|
| PATENT NO. | : 12,006,345 B2 | Page 1 of 1 |
| APPLICATION NO. | : 16/798247 | |
| DATED | : June 11, 2024 | |
| INVENTOR(S) | : Moore et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 46 days.

Signed and Sealed this
Thirty-first Day of December, 2024

Derrick Brent
*Acting Director of the United States Patent and Trademark Office*